(12) United States Patent
Chaikind et al.

(10) Patent No.: US 11,130,955 B2
(45) Date of Patent: Sep. 28, 2021

(54) APPLICATIONS OF CRISPRI IN HIGH THROUGHPUT METABOLIC ENGINEERING

(71) Applicant: Zymergen Inc., Emeryville, CA (US)

(72) Inventors: Brian Chaikind, Orinda, CA (US); Hendrik M. Van Rossum, Delft (NL); Aaron Miller, El Cerrito, CA (US); Paul Perkovich, Berkeley, CA (US); Shawn Szyjka, Martinez, CA (US); Kedar Patel, Fremont, CA (US)

(73) Assignee: Zymergen Inc., Emeryville, CA (US)

( * ) Notice: Subject to any disclaimer, the term of this patent is extended or adjusted under 35 U.S.C. 154(b) by 0 days.

(21) Appl. No.: 16/541,354

(22) Filed: Aug. 15, 2019

(65) Prior Publication Data

US 2020/0056191 A1 Feb. 20, 2020

Related U.S. Application Data

(60) Provisional application No. 62/764,672, filed on Aug. 15, 2018.

(51) Int. Cl.
*C12N 15/64* (2006.01)
*C12N 9/22* (2006.01)
*C12N 15/10* (2006.01)

(52) U.S. Cl.
CPC .......... *C12N 15/64* (2013.01); *C12N 15/102* (2013.01); *C12N 9/22* (2013.01); *C12N 2310/20* (2017.05)

(58) Field of Classification Search
CPC combination set(s) only.
See application file for complete search history.

(56) References Cited

U.S. PATENT DOCUMENTS

| | | | |
|---|---|---|---|
| 5,476,930 A | 12/1995 | Letsinger et al. | |
| 5,773,258 A | 6/1998 | Birch et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 10,266,850 B2 | 4/2019 | Doudna et al. | |
| 2014/0068797 A1* | 3/2014 | Doudna | C12N 15/63 800/18 |
| 2014/0356867 A1* | 12/2014 | Peter | C12Y 301/00 435/6.11 |
| 2015/0225730 A1* | 8/2015 | Minshull | C12N 15/66 435/91.41 |
| 2016/0201089 A1 | 7/2016 | Gersbach et al. | |
| 2020/0123540 A1 | 4/2020 | Chaikind et al. | |

FOREIGN PATENT DOCUMENTS

| | | | |
|---|---|---|---|
| WO | WO 2000/026381 A2 | 5/2000 | |
| WO | WO 2010/143917 A2 | 12/2010 | |
| WO | WO 2011/161413 A2 | 12/2011 | |
| WO | WO 2014/144761 A2 | 9/2014 | |
| WO | WO 2015/200334 A1 | 12/2015 | |
| WO | WO-2015200334 A1 * | 12/2015 | ............. C12N 15/66 |
| WO | WO 2016/109255 A1 | 7/2016 | |
| WO | WO 2017/037304 A2 | 3/2017 | |
| WO | WO 2018/013990 A1 | 1/2018 | |
| WO | WO 2018/148511 A1 | 8/2018 | |
| WO | WO 2020/086144 A1 | 4/2020 | |

OTHER PUBLICATIONS

Weber et al., A Modular Cloning System for Standardized Assembly of Multigene Constructs, Feb. 18, 2011, PLOS ONE, 6, pp. 1-11 (Year: 2011).*
Zhang et al., Multiplex gene regulation by CRISPR-ddCpf1, Jun. 6, 2017, Cell Discovery, 3, pp. 1-9 (Year: 2017).*
Engler et al., Golden Gate Shuffling: A One-Pot DNA Suffling Method Based on Type IIs Restriction Enzymes, May 14, 2009, PLOS ONE, 4, pp. 1-9 (Year: 2009).*
Li et al., C-Brick: A New Standard for Assembly of Biological Parts Using Cpf1, Published Jun. 13, 2016, ACS Synth. Biol., vol. 5, pp. 1383-1388 (Year: 2016).*
Ashley and Kushlan, "Chemical synthesis of oligodeoxynucleotide dumbbells." Biochemistry (Mar. 19, 1991); 30(11): 2927-2933.
Becker and Guarente, "[12] High-efficiency transformation of yeast by electroporation." Methods in Enzymology (1991); 194: 182-187.
Bhaya, et al., "CRISPR-Cas Systems in Bacteria and Archaea: Versatile Small RNAs for Adaptive Defense and Regulation". Annu Rev Genet. (Dec. 2011); 45: 273-297.
Bikard, et al., "Programmable repression and activation of bacterial gene expression using an engineered CRISPR-Cas system." Nucleic Acids Res. (Aug. 2013); 41(15): 7429-7437. Epub Jun. 12, 2013.
Čermák, et al., "A Multipurpose Toolkit to Enable Advanced Genome Engineering in Plants." Plant Cell (Jun. 2017); 29(6): 1196-1217. Epub May 18, 2017.
Chen, et al., "Dynamic Imaging of Genomic Loci in Living Human Cells by an Optimized CRISPR/Cas System." Cell (Dec. 19, 2013); 155(7): 1479-1491.
Cheng, et al., "Multiplexed activation of endogenous genes by CRISPR-on, an RNA-guided transcriptional activator system." Cell Res. (Oct. 2013); 23(10): 1163-1171. Epub Aug. 27, 2013.
Chu and Orgel, "Ligation of oligonucleotides to nucleic acids or proteins via disulfide bonds." Nucleic Acids Res. (May 11, 1988); 16(9): 3671-3691.

(Continued)

*Primary Examiner* — Channing S Mahatan
(74) *Attorney, Agent, or Firm* — Cooley LLP

(57) ABSTRACT

Methods, compositions, and kits for high throughput DNA assembly reactions in vitro. Modular CRISPR DNA constructs comprising modular insert DNA parts flanked by cloning tag segments comprising pre-validated CRISPR protospacer/protospacer adjacent motif sequence combinations. High throughput methods of CRISPRi and CRISPRa.

30 Claims, 23 Drawing Sheets

Specification includes a Sequence Listing.

(56) References Cited

OTHER PUBLICATIONS

Cleto, et al., "Corynebacterium glutamicum Metabolic Engineering with CRISPR Interference (CRISPRi)." ACS Synth Biol. (May 20, 2016); 5(5): 375-385. Published Feb. 1, 2016.

Cress, et al., "CRISPathBrick: Modular Combinatorial Assembly of Type II-A CRISPR Arrays for dCas9-Mediated Multiplex Transcriptional Repression in *E. coli*." ACS Synth Biol. (Sep. 18, 2015); 4(9): 987-1000. Published Mar. 30, 2015.

De Almeida., et al., "Transgenic expression of two marker genes under the control of an *Arabidopsis* rbcS promoter: Sequences encoding the Rubisco transit peptide increase expression levels." Molecular and General Genetics MGG (1989); 218(1): 78-86.

De Kok, et al., "Rapid and Reliable DNA Assembly via Ligase Cycling Reaction." ACS Synth Biol. (Feb. 21, 2014); 3(2): 97-106. Epub Jan. 15, 2014.

Deng, et al., "CASFISH: CRISPR/Cas9-mediated in situ labeling of genomic loci in fixed cells." Proc Natl Acad Sci U S A. (Sep. 22, 2015); 112(38):11870-11875. Epub Aug. 31, 2015.

DiCarlo, et al., "Genome engineering in *Saccharomyces cerevisiae* using CRISPR-Cas systems." Nucleic Acids Res. (Apr. 2013); 41(7): 4336-4343. Epub Mar. 4, 2013.

Dominguez, et al., "Beyond editing: repurposing CRISPR-Cas9 for precision genome regulation and interrogation." Nat Rev Mol Cell Biol. (Jan. 2016); 17(1): 5-15. Epub Dec. 16, 2015.

Esvelt, et al., "Orthogonal Cas9 Proteins for RNA-Guided Gene Regulation and Editing." Nat Methods (Nov. 2013); 10(11): 1116-1121. Epub Sep. 29, 2013.

Farzadfard, et al., "Tunable and Multifunctional Eukaryotic Transcription Factors Based on CRISPR/Cas." ACS Synth Biol. (Oct. 18, 2013); 2(10): 604-613. Epub Sep. 11, 2013.

Fonfara, et al., "Phylogeny of Cas9 determines functional exchangeability of dual-RNA and Cas9 among orthologous type II CRISPR-Cas systems". Nucleic Acids Res. (Feb. 2014); 42(4): 2577-2590. Epub Nov. 22, 2013.

Fujimoto, et al., "Conformation dependent DNA photoligation via sensitizer tethered 5-carboxyvinyluracil." Nucleic Acids Res Suppl. (2002); 2 (1): 155-156.

Fujimoto, et al., "Reversible photoligation of DNA via 5-vinyldeoxyuridine." Nucleic Acids Symp Ser. (1999); 42 (1): 39-40.

Fujimoto, et al., "Template directed DNA photoligation via substituted 2-deoxyuridine." Nucleic Acids Res Suppl. (2001); (1): 185-186.

Gesner, et al., "Recognition and maturation of effector RNAs in a CRISPR interference pathway". Nat Struct Mol Biol. (Jun. 2011); 18(6): 688-692. Epub May 15, 2011.

Gilbert, et al., "CRISPR-Mediated Modular RNA-Guided Regulation of Transcription in Eukaryotes." Cell (Jul. 18, 2013); 154(2): 442-451. Epub Jul. 11, 2013.

Gilbert, et al., "Genome-Scale CRISPR-Mediated Control of Gene Repression and Activation." Cell (Oct. 23, 2014); 159(3): 647-661. doi: 10.1016/j.cell.2014.09.029. Epub Oct. 9, 2014.

Gryaznov and Letsinger, "Template controlled coupling and recombination of oligonucleotide blocks containing thiophosphoryl groups." Nucleic Acids Res. (Mar. 25, 1993); 21(6): 1403-1408.

Gryaznov, et al., "Enhancement of selectivity in recognition of nucleic acids via chemical autoligation." Nucleic Acids Res. (1999); 22(12): 2366-2369.

Haurwitz, et al., "Sequence- and structure-specific RNA processing by a CRISPR endonuclease." Science (Sep. 10, 2010); 329(5997): 1355-1358.

Hsu, et al., "DNA targeting specificity of RNA-guided Cas9 nucleases." Nat Biotechnol. (Sep. 2013); 31(9): 827-832. Epub Jul. 21, 2013.

Ito, et al. "Transformation of intact yeast cells treated with alkali cations." Journal of Bacteriology (1983); 153(1): 163-168.

Jinek, et al., "A programmable dual RNA-guided DNA endonuclease in adaptive bacterial immunity". Science (Aug. 17, 2012); 337(6096): 816-821. Epub Jun. 28, 2012.

Jinek, et al., "Structures of Cas9 Endonucleases Reveal RNA-Mediated Conformational Activation". Science (Mar. 14, 2014); 343(6176): 1247997. Epub Feb. 6, 2014.

Jones, et al., "High level expression of introduced chimaeric genes in regenerated transformed plants." The EMBO Journal (1985); 4(10): 2411-2418.

Kabadi, et al., "Multiplex CRISPR/Cas9-based genome engineering from a single lentiviral vector." Nucleic Acids Res. (Oct. 29, 2014); 42(19): e147, 11 pages. Epub Aug. 13, 2014.

Kanaya and Yanagawa, "Template-directed polymerization of oligoadenylates using cyanogen bromide." Biochemistry (Nov. 18, 1986); 25(23): 7423-7430.

Kao and Ng, "CRISPRi mediated phosphoenolpyruvate carboxylase regulation to enhance the production of lipid in Chlamydomonas reinhardtii." Bioresour Technol. (Dec. 2017); 245(Pt B): 1527-1537. Epub May 4, 2017.

Kearns, et al., "Cas9 effector-mediated regulation of transcription and differentiation in human pluripotent stem cells." Development (Jan. 2014); 141(1): 219-223.

Khanna, et al. "Identification of the template binding polypeptide in the pea chloroplast transcriptional complex." Nucleic Acids Research (1992); 20(1): 69-74.

Kiani, et al., "Cas9 gRNA engineering for genome editing, activation and repression." Nat Methods (Nov. 2015); 12(11): 1051-1054. Epub Sep. 7, 2015.

Kim, et al., "Genome-wide analysis reveals specificities of Cpf1 endonucleases in human cells". Nat Biotechnol. (Aug. 2016); 34(8): 863-868. Epub Jun. 6, 2016.

Kleinstiver, et al., "Broadening the targeting range of *Staphylococcus aureus* CRISPR-Cas9 by modifying PAM recognition." Nat Biotechnol. (Dec. 2015); 33(12): 1293-1298. Epub Nov. 2, 2015.

Lin, et al., "Enhanced homology-directed human genome engineering by controlled timing of CRISPR/Cas9 delivery." Elife (Dec. 15, 2014); 3:e04766.

Liu and Taylor, "Template-directed photoligation of oligodeoxyribonucleotides via 4-thiothymidine." Nucleic Acids Res. (1999); 26(13): 3300-3304.

Lowder, et al., "A CRISPR/Cas9 Toolbox for Multiplexed Plant Genome Editing and Transcriptional Regulation." Plant Physiol. (Oct. 2015); 169(2): 971-985. Epub Aug. 21, 2015.

Luebke and Dervan, "Nonenymatic ligation of double-helical DNA by alternate-strand triple helix formation." Nucleic Acids Res. (Jun. 25, 1992); 20(12): 3005-3009.

Luo, et al., "Improving the fidelity of Thermus thermophilus DNA ligase". Nucleic Acids Res. (Aug. 1, 1996); 24(15): 3071-3078.

Makarova, et al., "An updated evolutionary classification of CRISPR-Cas systems". Nat Rev Microbiol. (Nov. 2015); 13(11): 722-736. Epub Sep. 28, 2015.

Mali, et al., "CAS9 transcriptional activators for target specificity screening and paired nickases for cooperative genome engineering." Nat Biotechnol. (Sep. 2013); 31(9): 833-838. Epub Aug. 1, 2013.

Margolin, et al., "Krüppel-associated boxes are potent transcriptional repression domains." Proc Natl Acad Sci U S A. (May 10, 1994); 91(10): 4509-4513.

Naylor and Gilham, "Studies on some interactions and reactions of oligonucleotides in aqueous solution." Biochemistry (Aug. 1966); 5(8): 2722-2728.

Nishimasu, et al., "Crystal Structure of Cas9 in Complex with Guide RNA and Target DNA". Cell (Feb. 27, 2014); 156(5): 935-949. Epub Feb. 13, 2014.

O'Connell, et al., "Programmable RNA recognition and cleavage by CRISPR/Cas9." Nature (Dec. 11, 2014); 516(7530): 263-266. Epub Sep. 28, 2014.

PCT/US2018/017573, International Preliminary Report on Patentability dated Aug. 13, 2019, 12 pages.

PCT/US2018/017573, International Search Report and Written Opinion, dated May 25, 2018, 15 pages.

Peters, et al., "A Comprehensive, CRISPR-based Functional Analysis of Essential Genes in Bacteria." Cell (Jun. 2, 2016); 165(6): 1493-1506. Epub May 26, 2016.

Purmal, et al., "A new affinity reagent for the site-specific, covalent attachment of DNA to active-site nucleophiles: application to the EcoRI and RsrI restriction and modification enzymes." Nucleic Acids Res. (Jul. 25, 1992); 20(14): 3713-3719.

(56) References Cited

OTHER PUBLICATIONS

Qi, et al., Repurposing CRISPR as an RNA-Guided Platform for Sequence-Specific Control of Gene Expression. Cell (Feb. 28, 2013); 152(5): 1173-1183.
Ren, et al., "Cloning of linear DNAs in vivo by overexpressed T4 DNA ligase: construction of a T4 phage hoc gene display vector." Gene (Aug. 22, 1997); 195(2): 303-311.
Sarrion-Perdigones, et al., "GoldenBraid 2.0: A Comprehensive DNA Assembly Framework for Plant Synthetic Biology." Plant Physiol. (Jul. 2013); 162(3): 1618-1631.
Schwartz, et al., "CRISPRi repression of nonhomologous end-joining for enhanced genome engineering via homologous recombination in Yarrowia lipolytica." Biotechnol Bioeng. (Dec. 2017); 114(12): 2896-2906. Epub Sep. 4, 2017.
Sievers and Von Kiedrowski, "Self-replication of complementary nucleotide-based oligomers." Nature (May 19, 1994); 369(6477): 221-224.
Smith, et al., "Quantitative CRISPR interference screens in yeast identify chemical-genetic interactions and new rules for guide RNA design." Genome Biol. (Mar. 8, 2016); 17: 45, 16 pages.
Sokolova, et al., "Chemical reactions within DNA duplexes Cyanogen bromide as an effective oligodeoxyribonucleotide coupling agent." FEBS Lett. (May 9, 1988); 32(1): 153-155.
Tang, et al., "A CRISPR-Cpf1 system for efficient genome editing and transcriptional repression in plants." Nature Plants (Feb. 17, 2017); 3: 17018, 21 pages.
Terns, et al., "CRISPR-Based Adaptive Immune Systems". Curr Opin Microbiol. (Jun. 2011); 14(3): 321-327. Epub Apr. 29, 2011.
Thakore, et al., "Highly Specific Epigenome Editing by CRISPR/Cas9 Repressors for Silencing of Distal Regulatory Elements." Nat Methods (Dec. 2015); 12(12): 1143-1149. Epub Oct. 26, 2015.
Tóth, et al., "Cpf1 nucleases demonstrate robust activity to induce DNA modification by exploiting homology directed repair pathways in mammalian cells." Biol Direct. (Sep. 14, 2016); 11: 46, 14 pages.
Wang and Kool, "Circular RNA oligonucleotides. Synthesis, nucleic acid binding properties, and a comparison with circular DNAs." Nucleic Acids Res. (Jun. 25, 1994); 22(12): 2326-2333.
Wang, et al., "CRISPR/Cas9 nuclease cleavage combined with Gibson assembly for seamless cloning." Biotechniques (Apr. 1, 2015); 58(4): 161-170. eCollection Apr. 2015.
Wiedenheft, et al., "RNA-guided genetic silencing systems in bacteria and archaea". Nature (Feb. 15, 2012); 482(7385): 331-338.
Wu and Wallace, "Specificity of the nick-closing activity of bacteriophage T4 DNA ligase". Gene (Mar. 30, 1989); 76(2): 245-254.
Xing, et al., "A CRISPR/Cas9 toolkit for multiplex genome editing in plants." BMC Plant Biol. (Nov. 29, 2014); 14: 327.
Xu and Kool, "High sequence fidelity in a non-enzymatic DNA autoligation reaction." Nucleic Acids Res. (Feb. 1, 1999); 27(3): 875-881.
Yamano, et al., "Crystal Structure of Cpf1 in Complex with Guide RNA and Target DNA." Cell (May 5, 2016); 165(4): 949-962. Epub Apr. 21, 2016.
Zalatan, et al., "Engineering Complex Synthetic Transcriptional Programs with CRISPR RNA Scaffolds." Cell (Jan. 15, 2015); 160(1-2): 339-350. Epub Dec. 18, 2014.
Zetsche, et al., "Cpf1 is a single RNA-guided endonuclease of a Class 2 CRISPR-Cas system". Cell (Oct. 22, 2015); 163(3): 759-771. Epub Sep. 25, 2015.
Zhao, et al., "CRISPR/dCas9-Mediated Multiplex Gene Repression in Streptomyces." Biotechnol J. (Sep. 2018); 13(9):e1800121. First published: Jun. 3, 2018. Epub Jul. 4, 2018.
Engler, et al., "Golden Gate Shuffling: A One-Pot DNA Shuffling Method Based on Type IIs Restriction Enzymes". PLoS ONE (May 14, 2009); e5553.
Hartley, et al., "DNA Cloning Using in Vitro Site-Specific Recombination". Genome Res. (Nov. 2000); 10(11): 1788-1795.
International Application No. PCT/US2019/046555, Invitation to Pay Additional Fees, dated May 5, 2020, 4 pages.
International Application No. PCT/US2019/046555, International Search Report and Written Opinion dated Jul. 2, 2020, 19 pages.

* cited by examiner

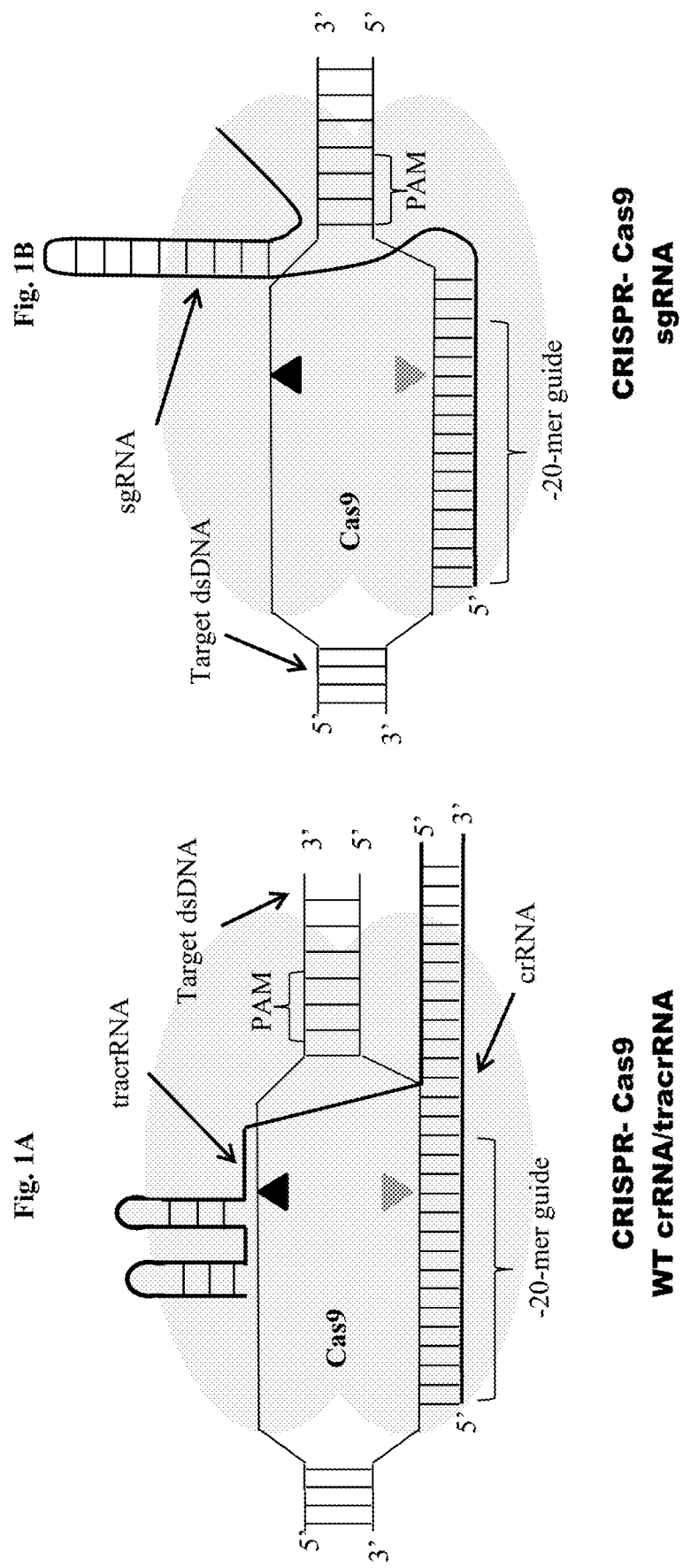
Fig. 1A-C

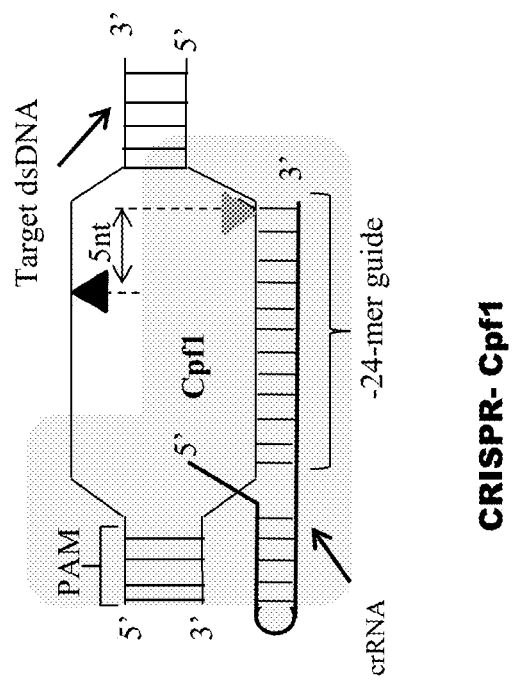
Fig. 1A-C (Continued)

Fig. 3A-D
Fig 3A
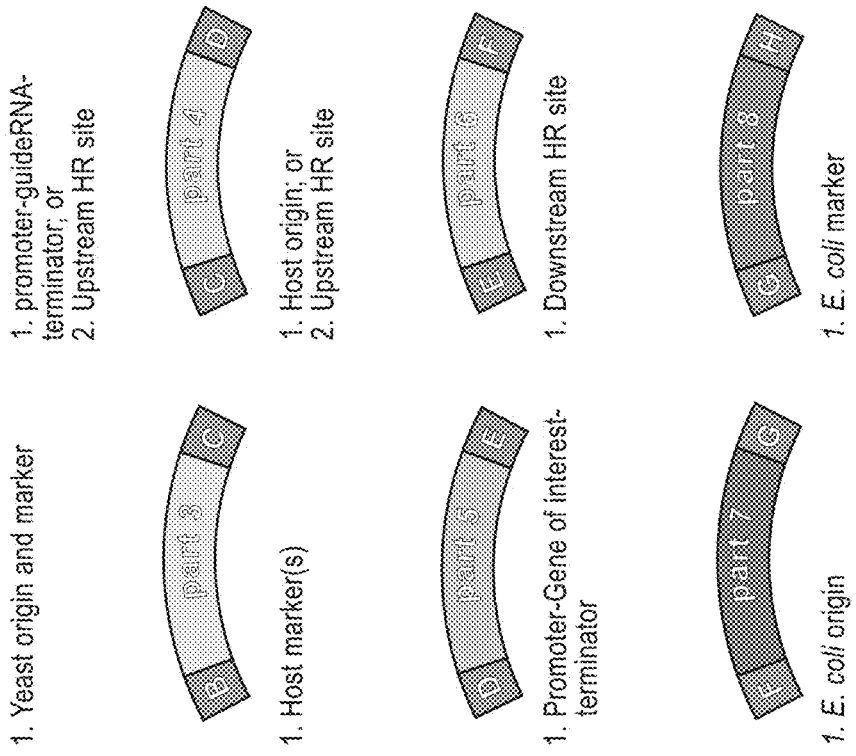
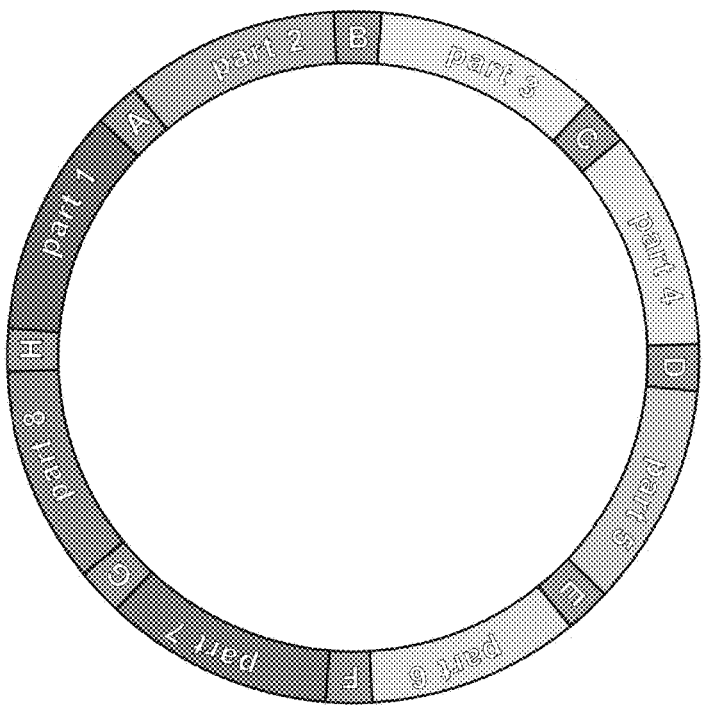

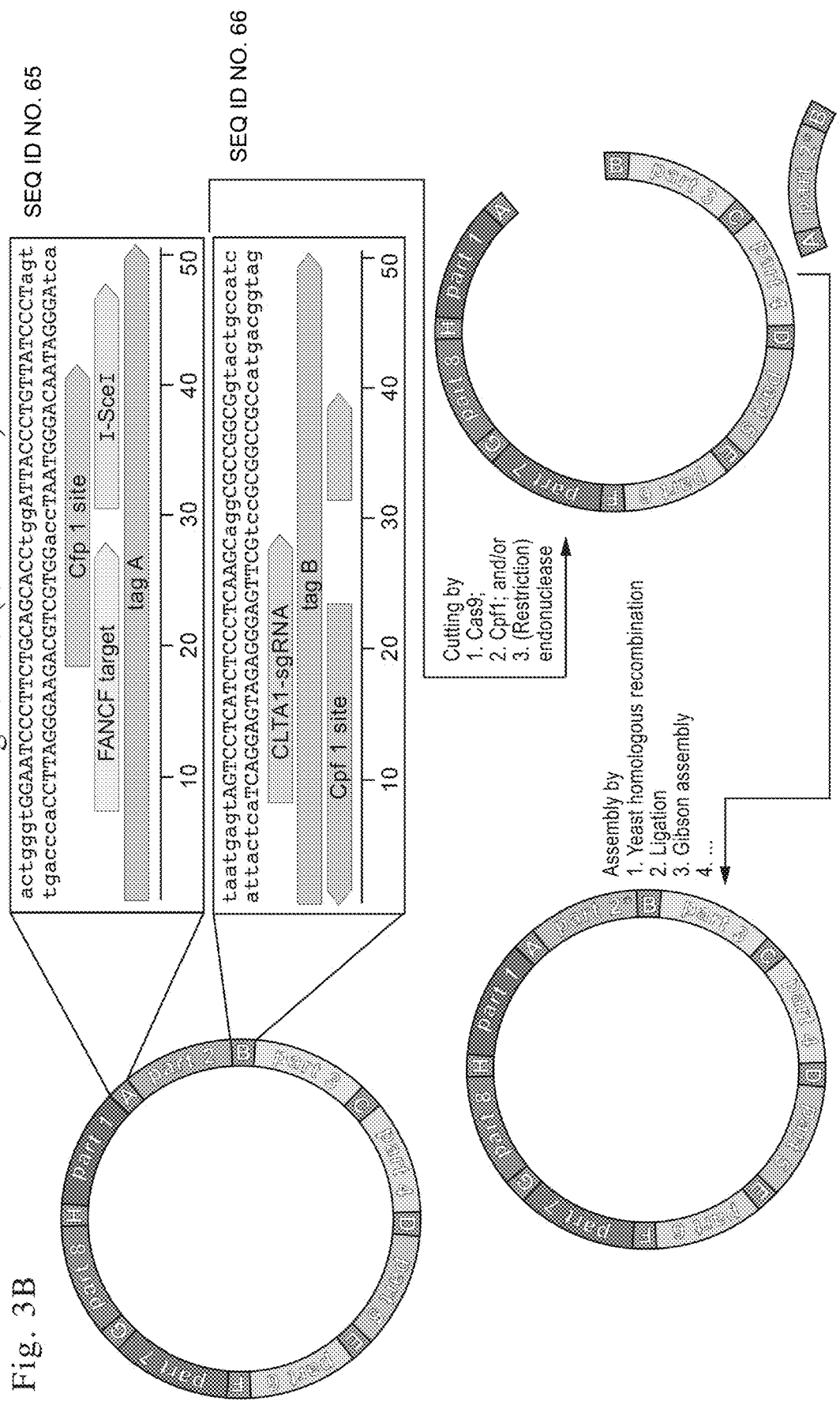
Fig. 3A-D (Continued)

APPLICATIONS OF CRISPRI IN HIGH THROUGHPUT METABOLIC ENGINEERING

CROSS-REFERENCE TO RELATED APPLICATIONS

This application claims the benefit of priority to U.S. Provisional Application No. 62/764,672, filed on Aug. 15, 2018, which is hereby incorporated by reference in its entirety, including all descriptions, references, figures, and claims for all purposes.

GOVERNMENT FUNDING

This invention was made with government support under Agreement No. HR0011-15-9-0014, awarded by DARPA. The government has certain rights in the invention.

STATEMENT REGARDING SEQUENCE LISTING

The sequence listing associated with this application is provided in text format in lieu of a paper copy, and is hereby incorporated by reference into the specification. The name of the text file containing the sequence listing is ZYMR_030_02US_SubSeqList_ST25. The text file is 822 kb, was created on Jul. 16, 2020, and is being submitted electronically via EFS-Web.

FIELD

The present disclosure relates to systems, methods, and compositions used for guided genetic sequence editing in vitro. The disclosure describes, inter alia, methods of using guided sequence editing complexes for improved DNA cloning, assembly of oligonucleotides, and for the improvement of microorganisms. The disclosure also describes high throughput methods of modulating the expression of host cell genes via mutant CRISPR enzymes.

BACKGROUND

A major area of interest in biology is the in vitro and in vivo targeted modification of genetic sequences. Indeed, one of the most significant bottlenecks to academic and commercial genetic research has been the speed with which novel genetic constructs could be generated or later modified prior to testing.

The currently available cloning techniques relying on restriction site recognition or DNA hybridization and amplification have proven to be slow, unreliable, and intractable to later modifications. The discovery of Clustered Regularly Interspaced Short Palindromic Repeats (CRISPR) gene editing systems have provided researchers with additional avenues for genetic modification. Even these new approaches, however, remain impractical for high throughput modular cloning applications.

For example, the use of catalytically active or inactivated CRISPR enzymes permit researchers to effectuate targeted gene expression repressions (CRISPRi) or activations (CRISPRa). These techniques however, are still subject to the technical limitations of CRISPR applications, and thus not optimized for high throughput applications.

CRISPR editing locations for example, are often limited by the location of protospacer adjacent motifs (PAMs). De novo CRISPR guide RNA design and gene targeting can be both time consuming and expensive, and is also susceptible to low efficiencies, and potential for off-target mutations.

Thus, there is a need for improved compositions and methods for targeted alteration of genetic sequences and modulation of gene expression.

SUMMARY OF THE DISCLOSURE

In some embodiments, the present disclosure teaches methods, compositions, and kits for high-throughput DNA assembly reactions in vivo and in vitro utilizing modular CRISPR DNA constructs.

Thus, in some embodiments, the present disclosure teaches CRISPR DNA constructs comprising modular insert DNA parts flanked by cloning tag segments comprising pre-validated CRISPR protospacer/protospacer adjacent motif (PAM) sequence combinations. In some embodiments, the present disclosure teaches digesting DNA with CRISPR endonucleases. In some embodiments, the present disclosure teaches digesting DNA with Type II—Class 2 CRISPR endonucleases (e.g. Cas9). In some embodiments, the present disclosure teaches digesting DNA with Type V—Class 2 CRISPR endonucleases. In some embodiments, the present disclosure teaches digesting DNA with Cpf1 endonucleases.

In some embodiments, the present disclosure teaches a recombinant modular CRISPR DNA construct comprising a CRISPR multi-clonal site, said multi-clonal site comprising: a) at least two distinct cloning tags (cTAG), wherein each cTAG comprises: i) one or more validated CRISPR landing sites, each comprising a protospacer sequence operably linked to a protospacer adjacent motif (PAM); wherein at least one of said validated CRISPR landing sites is unique within the modular CRISPR DNA construct; and b) one or more DNA insert sequences; i) wherein each of said cTAGs are distributed in flanking positions around each of the one or more DNA insert sequences; and ii) wherein at least one of said DNA insert sequences comprises a selection marker.

In some embodiments, the present disclosure teaches a recombinant modular CRISPR DNA construct, wherein said modular CRISPR DNA construct is circular.

In some embodiments, the present disclosure teaches a recombinant modular CRISPR DNA construct, wherein said modular CRISPR DNA construct is linear.

In some embodiments, the present disclosure teaches a recombinant modular CRISPR DNA construct, wherein said modular CRISPR DNA construct is integrated into the genome of an organism.

In some embodiments, the present disclosure teaches a recombinant modular CRISPR DNA construct, wherein at least one of said distinct cTAGs comprises at least two validated CRISPR landing sites.

In some embodiments, the present disclosure teaches a recombinant modular CRISPR DNA construct, wherein at least one of the CRISPR landing sites is for a Cas9 endonuclease.

In some embodiments, the present disclosure teaches a recombinant modular CRISPR DNA construct, wherein at least one of the CRISPR landing sites is for a RNA or DNA guided nuclease, for example, the Cpf1 endonuclease.

In some embodiments, the present disclosure teaches a recombinant modular CRISPR DNA construct, wherein at least one of said distinct cTAGs comprises a rare (≥8 bases long) restriction endonuclease site.

In some aspects, the disclosure refers to a recombinant modular CRISPR DNA construct as a "MegaModular" construct.

In some embodiments, the present disclosure teaches a method for preparing a recombinant nucleic acid molecule, the method comprising: a) forming a mixture comprising: i) a plurality of DNA insert parts, wherein each DNA insert part is flanked by two cloning tags (cTAGs), each cTAG comprising: 1) one or more validated CRISPR landing sites, each comprising a protospacer sequence operably linked to a protospacer adjacent motif (PAM); ii) one or more CRISPR complexes targeting at least one of said cTAGs present in at least two of the plurality of DNA insert parts, each CRISPR complex comprising; 1) a CRISPR endonuclease, and 2) a guide RNA or guide RNAs capable of recruiting said CRISPR endonuclease to one of said targeted cTAGs; wherein the mixture is incubated under conditions which allow for digestion of the targeted cTAG(s) in at least two of the plurality of DNA insert parts to generate overhanging ends, and b) incubating the digestion products generated in (a) in conditions which allow for hybridization of compatible overhanging ends and covalent joining of the hybridized ends; wherein the resulting recombinant nucleic acid molecule comprises the complete cTAG sequences of the original insert parts that are ligated in the method.

In some embodiments, the present disclosure teaches a method for preparing a recombinant nucleic acid molecule, wherein the CRISPR endonuclease is Cpf1.

In some embodiments, the present disclosure teaches a method for preparing a recombinant nucleic acid molecule, wherein the CRISPR endonuclease is a DNA or RNA guided endonuclease, for example, Cas9.

In some embodiments, the present disclosure teaches a method for preparing a recombinant nucleic acid molecule, wherein the method comprises the step of: i) separating the digested cTAG sequences from the CRISPR complexes prior to ligation, or ii) inactivating the CRISPR complexes prior to ligation.

In some embodiments, the present disclosure teaches a method for preparing a recombinant nucleic acid molecule, wherein the separation step comprises a DNA purification step.

In some embodiments, the present disclosure teaches a method for preparing a recombinant nucleic acid molecule, wherein the inactivation step comprises heat or chemical inactivation of said CRISPR complexes.

In some embodiments, the present disclosure teaches a method for preparing a recombinant nucleic acid molecule, wherein the two cTAGs for each of the plurality of DNA insert parts form a cTAG pair, and wherein said cTAG pair is unique from all other cTAG pairs of the DNA insert parts that are ligated in the method.

In some embodiments, the present disclosure teaches a method for preparing a recombinant nucleic acid molecule, wherein at least one of the cTAGs in each cTAG pair is the same as at least one other cTAG in a different cTAG pair.

In some embodiments, the present disclosure teaches a method for DNA sequence editing, said method comprising: a) introducing into a reaction: i) the modular CRISPR DNA construct of the present disclosure: ii) a replacement DNA insert part, wherein said replacement DNA insert part is flanked by a first and second insert cTAG; 1) wherein the first insert cTAG comprises the validated CRISPR landing site(s) of one of the distinct cTAGs of the modular CRISPR DNA construct, and the second insert cTAG comprises the validated CRISPR landing site(s) of another distinct cTAG of the modular CRISPR DNA construct; and iii) a first and second CRISPR complex targeting the first and second insert cTAGs, respectively, each CRISPR complex comprising: 1) a CRISPR endonuclease, and 2) a guide RNA capable of recruiting said CRISPR endonuclease to one of said targeted insert cTAGs; wherein the first and second CRISPR complexes cleave the first and second insert cTAGs and their corresponding distinct cTAGs to generate overhanging ends, and b) incubating the replacement DNA insert part and modular CRISPR DNA construct with digested cTAGs generated: (a) under conditions which allow for hybridization of compatible overhanging ends and covalent joining of the hybridized ends; wherein the resulting edited modular CRISPR DNA construct comprises the complete cTAG sequences of the original insert part that is ligated by the method.

In some embodiments, the present disclosure teaches a method for DNA sequence editing, wherein the reaction of step (b) comprises a functional ligase.

In some embodiments, the present disclosure teaches a method for DNA sequence editing, said method comprising: a) introducing into a reaction: i) the modular CRISPR DNA construct of the present disclosure; ii) at least two CRISPR complexes targeting two distinct cTAGs in the modular CRISPR DNA construct, each CRISPR complex comprising; 1) a CRISPR endonuclease, and 2) a guide RNA capable of recruiting said CRISPR endonuclease to one of said targeted distinct cTAGs; wherein the first and second CRISPR complexes cleave the two distinct cTAGs in the modular CRISPR DNA construct, wherein the resulting distinct cTAGs comprise overhang ends, and b) introducing into a second reaction: i) the modular CRISPR DNA construct with digested cTAGs generated in (a); and ii) a replacement DNA insert part, wherein said replacement DNA insert part is flanked by a first and second insert cTAG; 1) wherein the first insert cTAG comprises the polynucleotide sequence of one of the undigested distinct cTAGs that is cleaved in (a), and the second insert cTAG comprises the polynucleotide sequence of another undigested distinct cTAG that is cleaved in (a); and 2) wherein the first and second insert cTAGs comprise overhang ends that are compatible with the overhang ends of the distinct cTAGs from (a); under conditions which allow for hybridization of compatible the overhanging ends and covalent joining of the hybridized ends; wherein the resulting edited modular CRISPR DNA construct comprises the complete sequences of the original undigested distinct cTAGs that were targeted in (a).

In some embodiments, the present disclosure teaches a method for DNA sequence editing, wherein the reaction of step (b) comprises a functional ligase.

In some embodiments, the present disclosure teaches a method for DNA sequence editing, wherein the CRISPR endonuclease is Cpf1.

In some embodiments, the present disclosure teaches a method for DNA sequence editing, wherein step (a) further comprises digesting the two cleaved distinct cTAGs with a single stranded exonuclease, thereby producing the distinct cTAGs with overhang ends. In some aspects, one may add a ligase and polymerase to repair the junctions with a polymerase and ligase after the exonuclease step. In some aspects, this reaction can also be done with Cas9 digested, blunt-end cuts.

In some embodiments, the present disclosure teaches a method for DNA sequence editing, wherein the CRISPR endonuclease is Cas9.

In some embodiments, the disclosure provides for a host cell genome comprising a recombinant modular CRISPR DNA construct comprising a CRISPR multi-clonal site, said multi-clonal site comprising: a) at least two distinct cloning tag (cTAG), wherein each cTAG comprises: i) one or more validated CRISPR landing sites, each comprising a protospacer sequence operably linked to a protospacer adjacent motif (PAM); wherein at least one of said modular validated CRISPR landing sites is unique within the modular CRISPR DNA construct; and b) one or more DNA insert part(s); i) wherein each of said distinct cTAGs are distributed in flanking positions around each of the one or more DNA insert part(s).

In some embodiments, the disclosure provides for a method for preparing a recombinant nucleic acid molecule, the method comprising: a) incubating a mixture comprising: i) a plurality of DNA insert parts flanked by two cloning tags (cTAGs), each cTAG comprising: 1) one or more validated CRISPR landing sites, each comprising a protospacer sequence operably linked to a protospacer adjacent motif (PAM); and 2) a rare (≥8 base) restriction enzyme recognition site; wherein at least one of the cTAGs of at least two insert parts comprise the same restriction enzyme site; ii) one or more restriction enzymes targeting the rare restriction enzyme sites in at least two of the plurality of DNA insert parts; under conditions which allow for digestion of the targeted cTAG by the one or more restriction enzymes in at least two of the plurality of DNA insert parts to generate insert parts with digested DNA ends; and b) incubating the DNA insert part(s) with digested DNA ends generated in step (a) under conditions which allow for the covalent joining of the digested DNA ends; wherein the resulting recombinant nucleic acid molecule comprises the complete cTAG sequences of the original insert parts that are covalently joined in the method.

In some embodiments, the disclosure provides for a method for DNA sequence editing, said method comprising: a) providing: i) the modular CRISPR DNA construct of claim 1, wherein at least two of the distinct cTAGs comprise a rare (≥8 base) restriction enzyme recognition site; ii) a replacement DNA insert part, wherein said replacement DNA insert part is flanked by a first and second insert cTAG; 1) wherein the first insert cTAG comprises the rare restriction enzyme recognition site of one of the distinct cTAGs of the modular CRISPR DNA construct, and the second insert cTAG comprises the rare restriction enzyme recognition site of another distinct cTAG of the modular CRISPR DNA construct; and iii) one or more restriction enzymes targeting the rare restriction enzyme sites in the first and second insert cTAGs; wherein parts (i) and (ii) are each incubated with part (iii) in a single or separate reactions; wherein the one or more restriction enzymes cleave the rare restriction enzyme recognition sites of first and second insert cTAGs and their corresponding distinct cTAGs to generate digested DNA ends, and b) incubating the replacement DNA insert part and modular CRISPR DNA construct with digested DNA ends generated in step (a) under conditions which allow for the covalent joining of the digested DNA ends; wherein the resulting edited modular CRISPR DNA construct comprises the complete cTAG sequences of the original insert part that is covalently joined by the method.

In some embodiments, the disclosure provides for a method for preparing a recombinant nucleic acid molecule, the method comprising: a) incubating a mixture comprising: i) a plurality of DNA insert parts, wherein each DNA insert part is flanked by two cloning tags (cTAGs), each cTAG comprising: 1) one or more validated CRISPR landing sites, each comprising a protospacer sequence operably linked to a protospacer adjacent motif (PAM); wherein at least two of the DNA insert parts share the same cTAG; ii) a single stranded DNA (ssDNA) exonuclease; under conditions which allow for digestion of the shared cTAG in the least two DNA insert parts, thereby generating compatible overhang DNA ends in the at least two DNA insert parts, and b) incubating the DNA insert parts with digested cTAGs generated in (a) under conditions which allow for the hybridization and covalent joining of the compatible overhang DNA ends of the least two DNA insert parts; wherein the resulting recombinant nucleic acid molecule comprises the complete cTAG sequences of the shared cTAG before digestion. This reaction can also be conducted with a polymerase and or ligase that are used to fix junctions. Further, this can be carried out with a predigested vector.

In some embodiments, the present disclosure teaches a recombinant modular CRISPR DNA construct for modulating the expression of a host cell gene or engineering the host cell's genome, said construct comprising a CRISPR multi-clonal site, said multi-clonal site comprising: a) at least two distinct cloning tags (cTAGs), wherein each cTAG comprises: i) one or more validated CRISPR landing sites, each comprising a protospacer sequence operably linked to a protospacer adjacent motif (PAM); wherein at least one of said validated CRISPR landing sites is unique within the modular CRISPR DNA construct; and b) one or more DNA insert part(s); i) wherein each of said distinct cTAGs are distributed in flanking positions around each of the one or more DNA insert part(s); and wherein the one or more DNA insert part(s) comprises DNA for a modulator of CRISPR function.

In some embodiments, the recombinant modular CRISPR DNA construct of the present disclosure comprises the DNA encoding for a modulator of CRISPR function further comprises a selectable marker.

In some embodiments, the present disclosure teaches a recombinant modular CRISPR DNA construct wherein the modulator of CRISPR function is selected from the group consisting of: an origin of replication, a selectable marker, a counterselectable marker, an anti-CRISPR protein, a promoter, a terminator, a dCas protein, a dCpf1 protein, a barcode, a Cas9 protein, a Cpf1 protein, a DNA donor, and a protein that facilitates multiplexing.

In some embodiments, the present disclosure teaches a host cell comprising the recombinant modular CRISPR DNA construct as described in this specification.

In some embodiments, the present disclosure teaches a host cell, wherein the host cell comprises a nucleic acid molecule encoding a catalytically active CRISPR enzyme and a guide RNA capable of recruiting the catalytically activated CRISPR enzyme to a DNA target site. In some embodiments, the present disclosure teaches a host cell, wherein the host cell comprises a nucleic acid molecule encoding a catalytically inactivated CRISPR enzyme and a guide RNA capable of recruiting the catalytically inactivated CRISPR enzyme to a DNA target site.

In some embodiments, the present disclosure teaches a host cell, wherein the catalytically inactivated CRISPR enzyme is fused to a transcriptional activation protein.

In some embodiments, the present disclosure teaches a host cell, wherein the host cell further comprises nucleic acid molecule encoding a transcriptional activation protein that, when expressed, is capable of attaching itself to the catalytically inactivated CRISPR enzyme.

In some embodiments, the present disclosure teaches a host cell, wherein the transcriptional activation protein attaches itself to the catalytically inactivated CRISPR enzyme via a linking aptamer, or through protein-protein interactions.

In some embodiments, the present disclosure teaches a host cell, wherein the guide RNA is operably linked to an aptamer capable of attaching itself to a transcriptional activation protein.

In some embodiments, the present disclosure teaches a host cell, wherein the transcriptional activation protein is selected from the group consisting of: VP16, VP64, and VP160.

In some embodiments, the present disclosure teaches a recombinant modular CRISPR DNA construct, wherein said modular CRISPR DNA construct is circular.

In some embodiments, the present disclosure teaches a recombinant modular CRISPR DNA construct, wherein said modular CRISPR DNA construct is linear.

In some embodiments, the present disclosure teaches a recombinant modular CRISPR DNA construct, wherein said modular CRISPR DNA construct is integrated into the genome of an organism.

In some embodiments, the present disclosure teaches a recombinant modular CRISPR DNA construct, wherein at least one of said distinct cTAGs comprises at least two validated CRISPR landing sites.

In some embodiments, the present disclosure teaches a recombinant modular CRISPR DNA construct, wherein at least one of the CRISPR landing sites is for a Cas9 endonuclease.

In some embodiments, the present disclosure teaches a recombinant modular CRISPR DNA construct, wherein at least one of the CRISPR landing sites is for a Cpf1 endonuclease.

In some embodiments, the present disclosure teaches a recombinant modular CRISPR DNA construct, wherein at least one of said distinct cTAGs comprises a rare (≥8 bases long) restriction endonuclease site.

In some embodiments, the present disclosure teaches a recombinant modular CRISPR DNA construct, wherein the catalytically inactivated CRISPR enzyme is a mutated Cas9 endonuclease.

In some embodiments, the present disclosure teaches a recombinant modular CRISPR DNA construct, wherein the catalytically inactivated CRISPR enzyme is a mutated Cpf1 endonuclease.

In some embodiments, the present disclosure teaches a host cell, wherein the host cell comprises more than one nucleic acid guide RNA.

In some embodiments, the present disclosure teaches a host cell, wherein at least one of the guide RNAs comprises a different sequence than another guide RNA.

In some embodiments, the present disclosure teaches a host cell, wherein at least one of the guide RNAs targets a different DNA target site sequence than another guide RNA.

In some embodiments, the present disclosure teaches a host cell, wherein the host cell comprises more than one catalytically inactivated CRISPR enzyme.

In some embodiments, the present disclosure teaches a host cell, wherein at least one of the catalytically inactivated CRISPR enzymes comprises a different sequence than another catalytically inactivated CRISPR enzyme encoded in the construct.

In some embodiments, the present disclosure teaches insert parts, wherein one or more of the cTAGs is selected from the group consisting of SEQ ID NO: 65-74, 78-81, and combinations thereof.

In some embodiments, the present disclosure teaches a high throughput method of modulating the expression of one or more host cell genes, said method comprising the step of introducing the recombinant modular CRISPR DNA construct of the present disclosure into a host cell; wherein a DNA target site of a guide RNA is located within the host cell genome.

In some embodiments, the present disclosure teaches a high throughput method of modulating the expression of one or more host cell genes, wherein at least one insert part of the recombinant modular CRISPR DNA construct is integrated into the genome of the host cell.

In some embodiments, the present disclosure teaches a high throughput method of modulating the expression of one or more host cell genes, wherein the insert part regulates the function of a CRISPR protein.

In some embodiments, the present disclosure teaches a high throughput method of modulating the expression of one or more host cell genes, wherein the insert part regulates the function of a gRNA.

In some embodiments, the present disclosure teaches a high throughput method of modulating the expression of one or more host cell genes, wherein the recombinant modular CRISPR DNA construct remains in the host cell as extra chromosomal DNA.

In some embodiments, the present disclosure teaches a recombinant modular CRISPR DNA construct for screening CRISPR enzyme variants, said construct comprising a CRISPR multi-clonal site, said multi-clonal site comprising: a) at least two distinct cloning tags (cTAGs), wherein each cTAG comprises: i) one or more validated CRISPR landing sites, each comprising a protospacer sequence operably linked to a protospacer adjacent motif (PAM); wherein at least one of said validated CRISPR landing sites is unique within the modular CRISPR DNA construct; and b) one or more DNA insert part(s); i) wherein each of said distinct cTAGs are distributed in flanking positions around each of the one or more DNA insert part(s); wherein the construct further comprises: c) a first nucleic acid encoding a CRISPR enzyme, or an enzyme suspected of having CRISPR functionality ("putative CRISPR enzyme"); and d) a second nucleic acid encoding a guide RNA capable of binding to a DNA target site.

In some embodiments, the present disclosure teaches a high throughput method of screening CRISPR activity in a host cell, said method comprising the steps of: a) introducing the recombinant modular CRISPR DNA construct of the present disclosure into the host cell; wherein the DNA target site of a guide RNA is located within the host cell genome; and b) measuring the degree of DNA cleavage occurring at the DNA target site.

In some embodiments, the present disclosure teaches a high throughput method of screening CRISPRi and/or CRISPRa activity in a host cell, said method comprising the steps of: a) introducing the recombinant modular CRISPR DNA construct of the present disclosure into the host cell; wherein the DNA target site of a guide RNA is located within the host cell genome; and b) measuring the degree of transcriptional modulation occurring at the DNA target site.

BRIEF DESCRIPTION OF THE FIGURES

FIG. 1 A-C Illustrates a comparison of the CRISPR/Cas9 and CRISPR/Cpf1 systems of the present disclosure. FIG. 1A—Cas9 endonucleases are recruited to target dsDNA by tracrRNA and crRNA complexes. FIG. 1B—Cas9 endonucleases may also be recruited to target dsDNA by artificially fused tracrRNA and crRNA sequences known as single-guide RNAs (sgRNAs). Cas9 endonuclease produces blunt ends. FIG. 1C—Cpf1 endonucleases only require crRNA guide poly-ribonucleotides. Cpf1 endonuclease cleavage produces double stranded breaks with 5' overhangs.

FIG. 2 A-C Illustrates an embodiment of the present cloning methods utilizing modular CRISPR constructs of the present disclosure.

FIG. 3 A-D Illustrates an embodiment of the present cloning methods utilizing modular CRISPR constructs of the present disclosure. FIG. 3A—diagrams a modular CRISPR plasmid that can be easily altered with Cas9 or Cpf1 nucleases, according to present disclosure. Interchangeable parts represented by numbers are flanked by invariant cTAG sequences represented by letters. Parts may come pre-assembled, or may be assembled in vivo or in vitro based on cTAG sequence identity. Example insert parts are shown on the right of FIG. 3A. FIG. 3B—Several strategies such as Cas9, Cpf1, or restriction endonuclease cleavage at cTAGs may be used to replace individual parts without having to reassemble the entire plasmid. cTAG sequences may comprise one or more cloning sites, including, but not limited to Cas9, Cpf1, restriction, and/or recombination sites.

FIG. 15 illustrates a plasmid assembly by restriction enzyme digestion and ligation using the megamodular design of Example 3. FIG. 15 shows that a modular CRISPR plasmid backbone p1300283391 and a compatible GFP-containing insert DNA part are each digested with ApaI and PvuI restriction enzymes to create compatible cloning tag ends. The digested backbone and insert are ligated in vitro to create a new modular CRISPR construct.

FIG. 17 A-B Depicts CRISPRi technology validation in *Corynebacterium glutamicum* as described in Example 5.

FIG. 18 A-B Illustrates the potential for CRISPRi/CRISPRa libraries.

DETAILED DESCRIPTION

Definitions

Figure 2A:
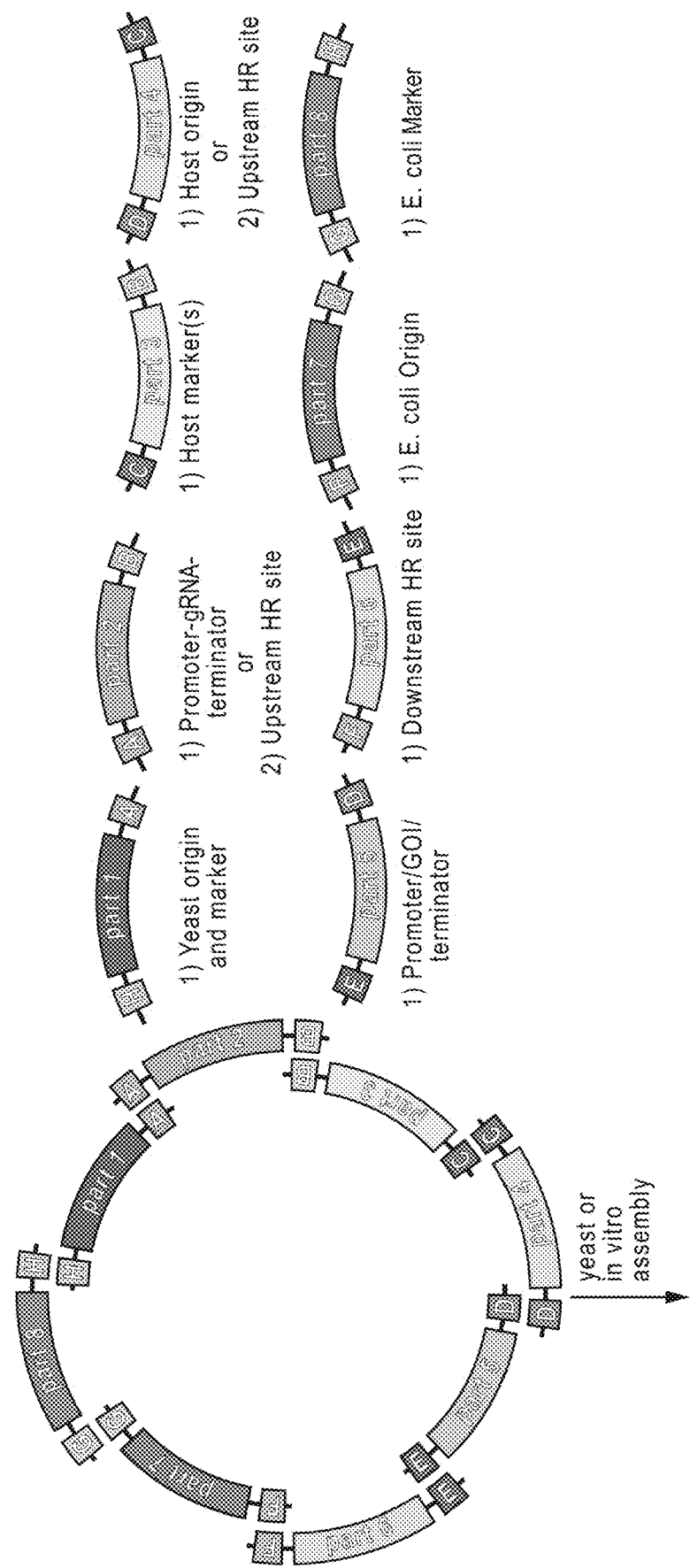
FIG. 2A—diagrams a modular CRISPR plasmid that can be easily altered with Cas9 or Cpf1 nucleases, according to the present disclosure. As aforementioned, the modular CRISPR constructs of the disclosure can be termed "MegaModular" constructs. Interchangeable parts represented by numbers are flanked by invariant cTAG sequences represented by letters. Parts may come pre-assembled, or may be assembled in vitro based on cTAG sequence identity. Example insert parts are shown on the right of FIG. 2A.

While the following terms are believed to be well understood by one of ordinary skill in the art, the following definitions are set forth to facilitate explanation of the presently disclosed subject matter.

The term "a" or "an" refers to one or more of that entity, i.e., can refer to a plural referent. As such, the terms "a" or "an", "one or more" and "at least one" are used interchangeably herein. In addition, reference to "an element" by the indefinite article "a" or "an" does not exclude the possibility that more than one of the elements is present, unless the context clearly requires that there is one and only one of the elements.

The term "prokaryotes" is art recognized and refers to organisms that do not contain a nucleus. The prokaryotes are generally classified in one of two domains, the Bacteria and the Archaea. The definitive difference between organisms of the Archaea and Bacteria domains is based on fundamental differences in the nucleotide base sequence in the 16S ribosomal RNA.

A "eukaryote" is any organism whose cells contain a nucleus and other organelles enclosed within membranes. Eukaryotes belong to the taxon Eukarya or Eukaryota. The defining feature that sets eukaryotic cells apart from prokaryotic cells (the aforementioned Bacteria and Archaea) is that they have membrane-bound organelles, especially the nucleus, which contains the genetic material, and is enclosed by the nuclear envelope.

The term "Archaea" refers to a categorization of organisms of the division Mendosicutes, typically found in unusual environments and distinguished from the rest of the prokaryotes by several criteria, including the number of ribosomal proteins and the lack of muramic acid in cell walls. On the basis of ssrRNA analysis, the Archaea consist of two phylogenetically-distinct groups: Crenarchaeota and Euryarchaeota. On the basis of their physiology, the Archaea can be organized into three types: methanogens (prokaryotes that produce methane); extreme halophiles (prokaryotes that live at very high concentrations of salt (NaCl)); and extreme (hyper) *Thermophilus* (prokaryotes that live at very high temperatures). Besides the unifying archaeal features that distinguish them from Bacteria (i.e., no murein in cell wall, ester-linked membrane lipids, etc.), these prokaryotes exhibit unique structural or biochemical attributes which adapt them to their particular habitats. The Crenarchaeota consists mainly of hyperthermophilic sulfur-dependent prokaryotes and the Euryarchaeota contains the methanogens and extreme halophiles.

"Bacteria" or "eubacteria" refers to a domain of prokaryotic organisms. Bacteria include at least 11 distinct groups as follows: (1) Gram-positive (gram+) bacteria, of which there are two major subdivisions: (1) high G+C group (Actinomycetes, Mycobacteria, *Micrococcus*, others) (2) low G+C group (*Bacillus, Clostridia, Lactobacillus*, Staphylococci, Streptococci, Mycoplasmas); (2) Proteobacteria, e.g., Purple photosynthetic+non-photosynthetic Gram-negative bacteria (includes most "common" Gram-negative bacteria); (3) Cyanobacteria, e.g., oxygenic phototrophs; (4) *Spirochetes* and related species; (5) *Planctomyces*; (6) *Bacteroides*, Flavobacteria; (7) *Chlamydia*; (8) Green sulfur bacteria; (9) Green non-sulfur bacteria (also anaerobic phototrophs); (10) Radioresistant micrococci and relatives; (11) *Thermotoga* and *Thermosipho thermophiles*.

The terms "genetically modified host cell," "recombinant host cell," and "recombinant strain" are used interchangeably herein and refer to host cells that have been genetically modified by the cloning and transformation methods of the present disclosure. Thus, the terms include a host cell (e.g., bacteria, yeast cell, fungal cell, CHO, human cell, etc.) that has been genetically altered, modified, or engineered, such that it exhibits an altered, modified, or different genotype and/or phenotype (e.g., when the genetic modification affects coding nucleic acid sequences of the microorganism), as compared to the naturally-occurring microorganism from which it was derived. It is understood that the terms refer not only to the particular recombinant microorganism in question, but also to the progeny or potential progeny of such a microorganism.

The term "genetically engineered" may refer to any manipulation of a host cell's genome (e.g. by insertion or deletion of nucleic acids).

As used herein, "selectable marker" is a nucleic acid segment that allows one to select for a molecule (e.g., a replicon) or a cell that contains it, often under particular conditions. These markers can encode an activity, such as, but not limited to, production of RNA, peptide, or protein, or can provide a binding site for RNA, peptides, proteins, inorganic and organic compounds or compositions and the like. Examples of selectable markers include but are not limited to: (1) nucleic acid segments that encode products which provide resistance against otherwise toxic compounds (e.g., antibiotics); (2) nucleic acid segments that encode products which are otherwise lacking in the recipient cell (e.g., tRNA genes, auxotrophic markers); (3) nucleic acid segments that encode products which suppress the activity of a gene product; (4) nucleic acid segments that encode products which can be readily identified (e.g., phenotypic markers such as β-galactosidase, green fluorescent protein (GFP), yellow fluorescent protein (YFP), cyan fluorescent protein (CFP), and cell surface proteins); (5) nucleic acid segments that encode products that bind other products which are otherwise detrimental to cell survival and/or function; (6) nucleic acid segments that encode nucleic acids that otherwise inhibit the activity of any of the nucleic acid segments resulting in a visible or selectable phenotype (e.g., antisense oligonucleotides); (7) nucleic acid segments that encode products that bind other products that modify a substrate (e.g. restriction endonucleases); (8) nucleic acid segments that can be used to isolate or identify a desired molecule (e.g. specific protein binding sites); (9) nucleic acid segments that encode a specific nucleotide sequence which can be otherwise non-functional (e.g., for PCR amplification of subpopulations of molecules); and (10) nucleic acid segments, which when absent, directly or indirectly confer resistance or sensitivity to particular compounds.

As used herein, "counterselectable marker" or a "counterselection marker" is a nucleic acid segment that eliminates or inhibits growth of a host organism upon selection. In some embodiments, the counterselectable markers of the present disclosure render the cells sensitive to one or more chemicals/growth conditions/genetic backgrounds. In some embodiments, the counterselectable markers of the present disclosure are toxic genes. In some embodiments, the counterselectable markers are expressed by inducible promoters.

As used herein, the term "nucleic acid" refers to a polymeric form of nucleotides of any length, either ribonucleotides or deoxyribonucleotides, or analogs thereof. This term refers to the primary structure of the molecule, and thus includes double- and single-stranded DNA, as well as double- and single-stranded RNA. It also includes modified nucleic acids such as methylated and/or capped nucleic acids, nucleic acids containing modified bases, backbone modifications, and the like. The terms "nucleic acid" and "nucleotide sequence" are used interchangeably.

As used herein, the term "gene" refers to any segment of DNA associated with a biological function. Thus, genes include, but are not limited to, coding sequences and/or the regulatory sequences required for their expression. Genes can also include non-expressed DNA segments that, for example, form recognition sequences for other proteins. Genes can be obtained from a variety of sources, including cloning from a source of interest or synthesizing from known or predicted sequence information, and may include sequences designed to have desired parameters.

As used herein, the term "homologous" or "homolog" or "ortholog" is known in the art and refers to related sequences that share a common ancestor or family member and are determined based on the degree of sequence identity. The terms "homology," "homologous," "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant disclosure such as deletion or insertion of one or more nucleotides that do not substantially alter the functional properties of the resulting nucleic acid fragment relative to the initial, unmodified fragment. It is therefore understood, as those skilled in the art will appreciate, that the disclosure encompasses more than the specific exemplary sequences. These terms describe the relationship between a gene found in one species, subspecies, variety, cultivar or strain and the corresponding or equivalent gene in another species, subspecies, variety, cultivar or strain. For purposes of this disclosure, homologous sequences are compared. "Homologous sequences" or "homologs" or "orthologs" are thought, believed, or known to be functionally related. A functional relationship may be indicated in any one of a number of ways, including, but not limited to: (a) degree of sequence identity and/or (b) the same or similar biological function. Preferably, both (a) and (b) are indicated. Homology can be determined using software programs readily available in the art, such as those discussed in Current Protocols in Molecular Biology (F. M. Ausubel et al., eds., 1987) Supplement 30, section 7.718, Table 7.71. Some alignment programs are MacVector (Oxford Molecular Ltd, Oxford, U.K.), ALIGN Plus (Scientific and Educational Software, Pennsylvania) and AlignX (Vector NTI, Invitrogen, Carlsbad, Calif.). Another alignment program is Sequencher (Gene Codes, Ann Arbor, Mich.), using default parameters.

As used herein, the term "nucleotide change" refers to, e.g., nucleotide substitution, deletion, and/or insertion, as is well understood in the art. For example, mutations contain alterations that produce silent substitutions, additions, or deletions, but do not alter the properties or activities of the encoded protein or how the proteins are made.

As used herein, the term "protein modification" refers to, e.g., amino acid substitution, amino acid modification, deletion, and/or insertion, as is well understood in the art.

As used herein, the term "at least a portion" or "fragment" of a nucleic acid or polypeptide means a portion having the minimal size characteristics of such sequences, or any larger fragment of the full length molecule, up to and including the full length molecule. A fragment of a polynucleotide of the disclosure may encode a biologically active portion of a genetic regulatory element. A biologically active portion of a genetic regulatory element can be prepared by isolating a portion of one of the polynucleotides of the disclosure that comprises the genetic regulatory element and assessing activity as described herein. Similarly, a portion of a polypeptide may be 4 amino acids, 5 amino acids, 6 amino acids, 7 amino acids, and so on, going up to the full length polypeptide. The length of the portion to be used will depend on the particular application. A portion of a nucleic acid useful as a hybridization probe may be as short as 12 nucleotides; in some embodiments, it is 20 nucleotides. A portion of a polypeptide useful as an epitope may be as short as 4 amino acids. A portion of a polypeptide that performs the function of the full-length polypeptide would generally be longer than 4 amino acids.

For PCR amplifications of the polynucleotides disclosed herein, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook et al. (2001) Molecular Cloning: A Laboratory Manual (3rd ed., Cold Spring Harbor Laboratory Press, Plainview, N.Y.). See also Innis et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York). Known methods of PCR include, but are not limited to, methods using paired primers, nested primers, single specific primers, degenerate primers, gene-specific primers, vector-specific primers, partially-mismatched primers, and the like.

The term "primer" as used herein refers to an oligonucleotide which is capable of annealing to the amplification target allowing a DNA polymerase to attach, thereby serving as a point of initiation of DNA synthesis when placed under conditions in which synthesis of primer extension product is induced, i.e., in the presence of nucleotides and an agent for polymerization such as DNA polymerase and at a suitable temperature and pH. The (amplification) primer is preferably single stranded for maximum efficiency in amplification. Preferably, the primer is an oligodeoxyribonucleotide. The primer must be sufficiently long to prime the synthesis of extension products in the presence of the agent for polymerization. The exact lengths of the primers will depend on many factors, including temperature and composition (A/T vs. G/C content) of primer. A pair of bi-directional primers consists of one forward and one reverse primer as commonly used in the art of DNA amplification such as in PCR amplification.

The terms "stringency" or "stringent hybridization conditions" refer to hybridization conditions that affect the stability of hybrids, e.g., temperature, salt concentration, pH, formamide concentration and the like. These conditions are empirically optimized to maximize specific binding and minimize non-specific binding of primer or probe to its target nucleic acid sequence. The terms as used include reference to conditions under which a probe or primer will hybridize to its target sequence, to a detectably greater degree than other sequences (e.g. at least 2-fold over background). Stringent conditions are sequence dependent and will be different in different circumstances. Longer sequences hybridize specifically at higher temperatures. Generally, stringent conditions are selected to be about 5° C. lower than the thermal melting point (Tm) for the specific sequence at a defined ionic strength and pH. The Tm is the temperature (under defined ionic strength and pH) at which 50% of a complementary target sequence hybridizes to a perfectly matched probe or primer. Typically, stringent conditions will be those in which the salt concentration is less than about 1.0 M Na+ ion, typically about 0.01 to 1.0 M Na+ ion concentration (or other salts) at pH 7.0 to 8.3 and the temperature is at least about 30° C. for short probes or primers (e.g. 10 to 50 nucleotides) and at least about 60° C.

for long probes or primers (e.g. greater than 50 nucleotides). Stringent conditions may also be achieved with the addition of destabilizing agents such as formamide. Exemplary low stringent conditions or "conditions of reduced stringency" include hybridization with a buffer solution of 30% formamide, 1 M NaCl, 1% SDS at 37° C. and a wash in 2×SSC at 40° C. Exemplary high stringency conditions include hybridization in 50% formamide, 1M NaCl, 1% SDS at 37° C., and a wash in 0.1×SSC at 60° C. Hybridization procedures are well known in the art and are described by e.g. Ausubel et al., 1998 and Sambrook et al., 2001. In some embodiments, stringent conditions are hybridization in 0.25 M Na2HPO4 buffer (pH 7.2) containing 1 mM Na2EDTA, 0.5-20% sodium dodecyl sulfate at 45° C., such as 0.5%, 1%, 2%, 3%, 4%, 5%, 6%, 7%, 8%, 9%, 10%, 11%, 12%, 13%, 14%, 15%, 16%, 17%, 18%, 19% or 20%, followed by a wash in 5×SSC, containing 0.1% (w/v) sodium dodecyl sulfate, at 55° C. to 65° C.

As used herein, the term "substantially identical" refers to two polynucleotide sequences that vary in no more than 1, 2, 3, 4, 5, 6, or 7 nucleotides. When used in the context of cTAGs, the term substantially identical denotes two cTAGs that would be identical, except for a mutation in the PAM or protospacer region of on one of the cTAGs designed to abrogate CRISPR cleavage in at least one CRISPR landing site. When the term substantially identical is used in conjunction with the term "partial" sequence or cTAG, the combination refers to the comparison between two substantially identical cTAGs as described above, wherein one of the cTAGs has been digested by a CRISPR endonuclease. Thus the term would be used to indicate that the cTAG being described was identical to a second cTAG (in its undigested form), except for the mutation in the PAM or protospacer region.

As used herein, the term "promoter" refers to a DNA sequence capable of controlling the expression of a coding sequence or functional RNA. The promoter sequence may consist of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue specificity of a promoter.

As used herein, the term "heterologous" refers to a nucleic acid sequence that is not naturally found in the particular organism.

As used herein, the term "endogenous," "endogenous gene," refers to the naturally occurring copy of a gene.

As used herein, the term "naturally occurring" refers to a gene or sequence derived from a naturally occurring source. In some embodiments, a naturally occurring gene refers to a gene of a wild type (non-transgene) gene, whether located in its endogenous setting within the source organism, or if placed in a "heterologous" setting, when introduced in a different organism. Thus, for the purposes of this disclosure, a "non-naturally occurring" sequence is a sequence that has been synthesized, mutated, or otherwise modified to have a different sequence from known natural sequences. In some embodiments, the modification may be at the protein level (e.g., amino acid substitutions). In other embodiments, the modification may be at the DNA level, without any effect on protein sequence (e.g., codon optimization). In some embodiments, the non-naturally occurring sequence may be a construct.

As used herein, the term "exogenous" is used interchangeably with the term "heterologous," and refers to a substance coming from some source other than its native source. For example, the terms "exogenous protein," or "exogenous gene" refer to a protein or gene from a non-native source or location, and that have been artificially supplied to a biological system. Artificially mutated variants of endogenous genes are considered "exogenous" for the purposes of this disclosure.

As used herein, the phrases "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such construct may be used by itself or may be used in conjunction with a vector. If a vector is used then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the disclosure. The skilled artisan will also recognize that different independent transformation events will result in different levels and patterns of expression (Jones et al., (1985) EMBO J. 4:2411-2418; De Almeida et al., (1989) Mol. Gen. Genetics 218:78-86), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others. Vectors can be plasmids, viruses, bacteriophages, pro-viruses, phagemids, transposons, artificial chromosomes, and the like, that replicate autonomously or can integrate into a chromosome of a host cell. A vector can also be a naked RNA polynucleotide, a naked DNA polynucleotide, a polynucleotide composed of both DNA and RNA within the same strand, a poly-lysine-conjugated DNA or RNA, a peptide-conjugated DNA or RNA, a liposome-conjugated DNA, or the like, that is not autonomously replicating. As used herein, the term "expression" refers to the production of a functional end-product e.g., an mRNA or a protein (precursor or mature).

The term "operably linked" means, in the context the sequential arrangement of the promoter polynucleotide according to the disclosure with a further oligo- or polynucleotide, resulting in transcription of said further polynucleotide. In some embodiments, the promoter sequences of the present disclosure are inserted just prior to a gene's 5'UTR, or open reading frame. In other embodiments, the operably linked promoter sequences and gene sequences of the present disclosure are separated by one or more linker nucleotides. The term "operably linked" in the context of CRISPR protospacers and prospacer adjacent motifs (PAMs) refers to a proximately placed protospacer/PAM combination sequence that is capable of being cleaved at high efficiency by a CRISPR endonuclease complex. The term "operably linked" in the context of guide RNA/aptamers refers to a guide RNA that is capable of recruiting a CRISPR endonuclease to a DNA target site, while also recruiting a second effector peptide via its aptamer sequence (e.g., capable of recruiting the transcriptional activation domain targeted by the aptamer). The term "operably linked" in the context of the terminator sequences, means the arrangement of the terminator sequence to end transcription of an upstream sequence. In some embodiments, the terminator sequences are placed at the end of a gene or operon.

The term "CRISPR RNA" or "crRNA" refers to the RNA strand responsible for hybridizing with target DNA sequences, and recruiting CRISPR endonucleases. crRNAs may be naturally occurring, or may be synthesized according to any known method of producing RNA.

The term "guide sequence" or "spacer" refers to the portion of a crRNA or guide RNA (gRNA) that is responsible for hybridizing with the target DNA.

The term "protospacer" refers to the DNA sequence targeted by a crRNA or guide strand. In some embodiments, the protospacer sequence hybridizes with the crRNA guide sequence of a CRISPR complex.

The term "seed region" refers to the ribonucleic sequence responsible for initial complexation between a DNA sequence CRISPR ribonucleoprotein complex. Mismatches between the seed region and a target DNA sequence have a stronger effect on target site recognition and cleavage than the remainder of the crRNA/sgRNA sequence. In some embodiments, a single mismatch in the seed region of a crRNA/gRNA can render a CRISPR complex inactive at that binding site. In some embodiments, the seed regions for Cas9 endonucleases are located along the last ~12 nts of the 3' portion of the guide sequence, which correspond (hybridize) to the portion of the protospacer target sequence that is adjacent to the PAM. In some embodiments, the seed regions for Cpf1 endonucleases are located along the first ~5 nts of the 5' portion of the guide sequence, which correspond (hybridize) to the portion of the protospacer target sequence adjacent to the PAM.

The term "target site" means, in the context of CRISPR, the loci to which the guideRNA (e.g., the single-guide RNA, or tracrRNA) complexes with its corresponding seed region, such that the guide RNA would be capable of recruiting a CRISPR endonuclease (active, or otherwise) to that portion of DNA.

The term "tracrRNA" refers to a small trans-encoded RNA. TracrRNA is complementary to and base pairs with crRNA to form a crRNA/tracrRNA hybrid, capable of recruiting CRISPR endonucleases to target sequences.

The term "Guide RNA" or "gRNA" as used herein refers to an RNA sequence or combination of sequences capable of recruiting a CRISPR endonuclease to a target sequence. Thus as used herein, a guide RNA can be a natural or synthetic crRNA (e.g., for Cpf1), a natural or synthetic crRNA/tracrRNA hybrid (e.g., for Cas9), or a single-guide RNA (sgRNA). Claims reciting expression or nucleotides encoding for a guide RNA can therefore refer to expression/encoding of single-guide RNA sequences, crRNA, and/or both crRNA and tracrRNA as distinct molecules.

The term "CRISPR landing site" as used herein, refers to a DNA sequence capable of being targeted by a CRISPR complex. Thus, in some embodiments, a CRISPR landing site comprises a proximately placed protospacer/Protopacer Adjacent Motif combination sequence that is capable of being cleaved a CRISPR endonuclease complex. The term "validated CRISPR landing site" refers to a CRISPR landing site for which there exists a guide RNA capable of inducing high efficiency cleaving of said sequence. Thus, the term validated should be interpreted as meaning that the sequence has been previously shown to be cleavable by a CRISPR complex. Each "validated CRISPR landing site" will by definition confirm the existence of a tested guide RNA associated with the validation. The term "validated CRISPR landing site" should further be understood to mean that the landing site was artificially designed and added to a DNA sequence with the express purpose of serving as a high efficiency and reliable DNA cleavage target. The "validated CRISPR landing site" of the present disclosure therefore, excludes sequences in previously existing plasmids, that were not originally designed as CRISPR targeting sites, but which are later cleaved through the creation of custom CRISPR complexes targeting regions of the plasmid.

The term "sticky end(s)" refers to double stranded polynucleotide molecule end that comprises a sequence overhang. In some embodiments, the sticky end can be a dsDNA molecule end with a 5' or 3' sequence overhang. In some embodiments, the sticky ends of the present disclosure are capable of hybridizing with compatible sticky ends of the same or other molecules. Thus, in one embodiment, a sticky end on the 3' of a first DNA fragment may hybridize with a compatible sticky end on a second DNA fragment. In some embodiments, these hybridized sticky ends can be sewn together by a ligase. In other embodiments, the sticky ends might require extension of the overhangs to complete the dsDNA molecule prior to ligation. The term "genetic scar(s)" refers to any undesirable sequence introduced into a nucleic acid sequence by DNA manipulation methods. For example, in some embodiments, the present disclosure teaches genetic scars such as restriction enzyme binding sites, sequence adapters or spacers to accommodate cloning, TA-sites, scars left over from NHEJ, etc. In some embodiments, the present disclosure teaches methods of scarless cloning and gene editing.

As used herein the term "targeted" refers to the expectation that one item or molecule will interact with another item or molecule with a degree of specificity, so as to exclude non-targeted items or molecules. For example, a first polynucleotide that is targeted to a second polynucleotide, according to the present disclosure has been designed to hybridize with the second polynucleotide in a sequence specific manner (e.g., via Watson-Crick base pairing). In some embodiments, the selected region of hybridization is designed so as to render the hybridization unique to the one, or more targeted regions. A second polynucleotide can cease to be a target of a first targeting polynucleotide, if its targeting sequence (region of hybridization) is mutated, or is otherwise removed/separated from the second polynucleotide.

The disclosure refers to the taught and described universal modular CRISPR DNA constructs or designs as a "Mega-Modular" construct or design.

DNA Nucleases

In some embodiments, the present disclosure teaches methods and compositions for gene editing/cloning utilizing DNA nucleases. CRISPR complexes, transcription activator-like effector nucleases (TALENs), zinc finger nucleases (ZFNs), and FokI restriction enzymes are some of the sequence-specific nucleases that have been used as gene editing tools. These enzymes are able to target their nuclease activities to desired target loci through interactions with guide regions engineered to recognize sequences of interest. In some embodiments, the present disclosure teaches CRISPR-based gene editing methods The principles of in vivo CRISPR-based editing largely rely on natural cellular DNA repair systems. Double-stranded dsDNA breaks introduced by nucleases are repaired by either non-homologous end-joining (NHEJ) or homology-directed repair (HDR), or single strand annealing, (SSA), or microhomology end joining (MMEJ).

HDR relies on a template DNA containing sequences homologous to the region surrounding the targeted site of DNA cleavage. Cellular repair proteins use the homology between the exogenously supplied or endogenous DNA sequences and the site surrounding a DNA break to repair the dsDNA break, replacing the break with the sequence on the template DNA. Failure to integrate the template DNA however, can result in NHEJ, MMEJ, or SSA. NHEJ, MMEJ and SSA are error-prone processes that are often accompanied by insertion or deletion of nucleotides (indels) at the target site, resulting in genetic knockout (silencing) of the targeted region of the genome due to frameshift mutations or insertions of a premature stop codon. Cpf1-mediated editing can also function via traditional hybridization of overhangs created by the endonuclease, followed by ligation.

CRISPR endonucleases are also useful for in vitro DNA manipulations, as discussed in later sections of this disclosure.

CRISPR Systems

CRISPR (Clustered Regularly Interspaced Short Palindromic Repeats) and CRISPR-associated (cas) endonucleases were originally discovered as adaptive immunity systems evolved by bacteria and archaea to protect against viral and plasmid invasion. Naturally occurring CRISPR/Cas systems in bacteria are composed of one or more Cas genes and one or more CRISPR arrays consisting of short palindromic repeats of base sequences separated by genome-targeting sequences acquired from previously encountered viruses and plasmids (called spacers). (Wiedenheft, B., et. al. Nature. 2012; 482:331; Bhaya, D., et. al., Annu. Rev. Genet. 2011; 45:231; and Terms, M. P. et. al., Curr. Opin. Microbiol. 2011; 14:321). Bacteria and archaea possessing one or more CRISPR loci respond to viral or plasmid challenge by integrating short fragments of foreign sequence (protospacers) into the host chromosome at the proximal end of the CRISPR array. Transcription of CRISPR loci generates a library of CRISPR-derived RNAs (crRNAs) containing sequences complementary to previously encountered invading nucleic acids (Haurwitz, R. E., et. al., Science. 2012:329; 1355; Gesner, E. M., et. al., Nat. Struct. Mol. Biol. 2001:18; 688; Jinek, M., et. al., Science. 2012:337; 816-21). Target recognition by crRNAs occurs through complementary base pairing with target DNA, which directs cleavage of foreign sequences by means of Cas proteins. (Jinek et. al. 2012 "A Programmable dual-RNA-guided DNA endonuclease in adaptive bacterial immunity." Science. 2012:337; 816-821).

There are at least five main CRISPR system types (Type I, II, III, IV and V) and at least 16 distinct subtypes (Makarova, K. S., et al., Nat Rev Microbiol. 2015. Nat. Rev. Microbiol. 13, 722-736). CRISPR systems are also classified based on their effector proteins. Class 1 systems possess multi-subunit crRNA-effector complexes, whereas in class 2 systems all functions of the effector complex are carried out by a single protein (e.g., Cas9 or Cpf1). In some embodiments, the present disclosure teaches using type II and/or type V single-subunit effector systems. Thus, in some embodiments, the present disclosure teaches using class 2 CRISPR systems.

CRISPR/Cas9

In some embodiments, the present disclosure teaches methods of gene editing using a Type II CRISPR system. In some embodiments, the Type II CRISPR system uses the Cas9 enzyme. Type II systems rely on a i) single endonuclease protein, ii) a transactivating crRNA (tracrRNA), and iii) a crRNA where a ~20-nucleotide (nt) portion of the 5' end of crRNA is complementary to a target nucleic acid. The region of a CRISPR crRNA strand that is complementary to its target DNA protospacer is hereby referred to as "guide sequence."

In some embodiments, the tracrRNA and crRNA components of a Type II system can be replaced by a single-guide RNA (sgRNA). The sgRNA can include, for example, a nucleotide sequence that comprises an at least 12-20 nucleotide sequence complementary to the target DNA sequence (guide sequence) and can include a common scaffold RNA sequence at its 3' end. As used herein, "a common scaffold RNA" refers to any RNA sequence that mimics the tracrRNA sequence or any RNA sequences that function as a tracrRNA.

Cas9 endonucleases produce blunt end DNA breaks and are recruited to target DNA by a combination of a crRNA and a tracrRNA oligos, which tether the endonuclease via complementary hybridization of the RNA CRISPR complex. (see solid triangle arrows in FIG. 1A).

In some embodiments, DNA recognition by the crRNA/endonuclease complex requires additional complementary base-pairing with a protospacer adjacent motif (PAM) (e.g., 5'-NGG-3') located in a 3' portion of the target DNA, downstream from the target protospacer. (Jinek, M., et. al., Science. 2012:337; 816-821). In some embodiments, the PAM motif recognized by a Cas9 varies for different Cas9 proteins.

In some embodiments, one skilled in the art can appreciate that the Cas9 disclosed herein can be any variant derived or isolated from any source. For example, in some embodiments, the Cas9 peptide of the present disclosure can include one or more of SEQ ID Nos selected from SEQ ID NO: 1, SEQ ID NO: 2, SEQ ID NO: 3, SEQ ID NO: 4, SEQ ID NO: 5, and SEQ ID NO: 6. In other embodiments, the Cas9 peptide of the present disclosure can include one or more of the mutations described in the literature, including but not limited to the functional muta tions described in: Fonfara et al. Nucleic Acids Res. 2014 February; 42(4): 2577-90; Nishimasu H. et al. Cell. 2014 Feb. 27; 156(5): 935-49; Jinek M. et al. Science. 2012 337:816-21; and Jinek M. et al. Science. 2014 Mar. 14; 343(6176); see also U.S. patent application Ser. No. 13/842,859, filed Mar. 15, 2013, which is hereby incorporated by reference; further, see U.S. Pat. Nos. 8,697,359; 8,771,945; 8,795,965; 8,865,406; 8,871,445; 8,889,356; 8,895,308; 8,906,616; 8,932,814; 8,945,839; 8,993,233; and 8,999,641, which are all hereby incorporated by reference. Thus, in some embodiments, the systems and methods disclosed herein can be used with the wild type Cas9 protein having double-stranded nuclease activity, Cas9 mutants that act as single stranded nickases, or other mutants with modified nuclease activity.

The present disclosure further envisions the use of catalytically inactivated Cas9 mutants, as described in further detail in later sections of this document. In some embodiments, the term "catalytically inactivated" or "catalytically inactive" CRISPR refers to a CRISPR protein in which the DNAase catalytic domain is non-functional (i.e., the enzyme no longer cleaves DNA). Thus in some embodiments, the present disclosure teaches dCas9 mutants. A non-limiting list of mutations that reduce or eliminate nuclease in Cas9 includes: D10, G12, G17, E762, H840, N854, N863, H982, H983, A984, D986, or A987, or a mutation in a corresponding location in a Cas9 homologue or ortholog. The mutation(s) can include substitution with any natural (e.g., alanine) or non-natural amino acid, or deletion. An exemplary nuclease defective dCas9 protein is Cas9D10A&H840A (Jinek, et al., Science. 2012 Aug. 17; 337(6096):816-21; Qi, et al., Cell. 2013 Feb. 28; 152(5): 1173-83). A non-limiting list of dCas9 variants are provided in Table 1.

TABLE 1

Non-limiting list of dCas9 Vectors

| Plasmid | Gene/Insert | Promoter | Selectable Marker | Publication |
|---|---|---|---|---|
| Plant | | | | |
| pYPQ153 | pco-dCas9-3X(SRDX) (Plant codon-optimized) (Other) | | | A CRISPR/Cas9 toolbox for multiplexed plant genome editing and transcriptional regulation. Plant Physiol. 2015 Aug. 21. pii: pp.00636.2015. |
| pYPQ233 (dLbCpf1-SRDX) | LbCpf1-SRDX (Other) | | | A CRISPR-Cpf1 system for efficient genome editing and transcriptional repression in plants. Nat Plants. 2017 Feb. 17; 3: 17018. doi: 10.1038/nplants.2017.18. |
| pYPQ223 (dAsCpf1-SRDX) | dAsCpf1-SRDX (Other) | | | A CRISPR-Cpf1 system for efficient genome editing and transcriptional repression in plants. Nat Plants. 2017 Feb. 17; 3: 17018. doi: 10.1038/nplants.2017.18. |
| pHSN6I01 | dCas9-KRAB (Synthetic), gRNA scaffold (Synthetic) | 2 × 35Sp, AtU6-26p | Hygromycin | A CRISPR/Cas9 toolkit for multiplex genome editing in plants. BMC Plant Biol. 2014 Nov. 29; 14(1): 327. |
| pMOD_A0801 | Csy4-P2A-AtCas9_dead (D10A + H840A) (Synthetic) | 35S | | A multi-purpose toolkit to enable advanced genome engineering in plants. Plant Cell. 2017 May 18. pii: tpc.00922.2016. doi: 10.1105/tpc.16.00922. |
| pBUN6I11 | dCas9-KRAB (Synthetic), gRNA scaffold (Synthetic) | Ubi1p, OsU3p | Bar | A CRISPR/Cas9 toolkit for multiplex genome editing in plants. BMC Plant Biol. 2014 Nov. 29; 14(1): 327. |
| pHdzCas9-KRAB | | CaMV35S | Hygromycin | CRISPRi mediated phosphoenolpyruvate carboxylase regulation to enhance the production of lipid in *Chlamydomonas reinhardtii*. Bioresour Technol. 2017 May 4. pii: S0960-8524(17)30619-3. doi: 10.1016/j.biortech.2017.04.111. |
| pMOD_A0402 | AtCas9_dead (D10A + H840A) (Synthetic) | AtUbi10 | | A multi-purpose toolkit to enable advanced genome engineering in plants. Plant Cell. 2017 May 18. pii: tpc.00922.2016. doi: 10.1105/tpc.16.00922. |
| pEGB 35S:dCas9:Tnos (GB1191) | dCas9 (Other) | 35S | | GoldenBraid 2.0: a comprehensive DNA assembly framework for plant synthetic biology. Plant Physiol. 2013 July; 162(3): 1618-31. |
| pMOD_A1810 | Csy4-P2A-TaCas9_dead (D10A + H840A) (Synthetic) | ZmUbi | | A multi-purpose toolkit to enable advanced genome engineering in plants. Plant Cell. 2017 May 18. pii: tpc.00922.2016. doi: 10.1105/tpc.16.00922. |
| Mammalian | | | | |
| pHR-SFFV-KRAB-dCas9-P2A-mCherry | KRAB-dCas9-P2A-mCherry fusion (*Homo sapiens*) | SFFV | mCherry | Genome-Scale CRISPR-Mediated Control of Gene Repression and Activation. Cell. 2014 Oct. 23; 159(3): 647-61. doi: 10.1016/j.cell.2014.09.029. Epub 2014 Oct. 9. |

TABLE 1-continued

Non-limiting list of dCas9 Vectors

| Plasmid | Gene/Insert | Promoter | Selectable Marker | Publication |
| --- | --- | --- | --- | --- |
| pHR-SFFV-dCas9-BFP-KRAB | dCas9-BFP-KRAB fusion (*Homo sapiens*) | SFFV | | CRISPR-Mediated Modular RNA-Guided Regulation of Transcription in Eukaryotes. Cell. 2013 Jul. 9. pii: S0092-8674(13)00826-X. doi: 10.1016/j.cell.2013.06.044. |
| pLV hU6-sgRNA hUbC-dCas9-KRAB-T2a-GFP | humanized dCas9-KRAB T2A GFP (Other), sgRNA | | | Highly specific epigenome editing by CRISPR-Cas9 repressors for silencing of distal regulatory elements.Nat Methods. 2015 December; 12(12): 1143-9. doi: 10.1038/nmeth.3630. Epub 2015 Oct. 26. |
| pLV hU6-sgRNA hUbC-dCas9-KRAB-T2a-Puro | humanized dCas9-KRAB T2A Puro (Other), sgRNA | | Puromycin | Highly specific epigenome editing by CRISPR-Cas9 repressors for silencing of distal regulatory elements.Nat Methods. 2015 December; 12(12): 1143-9. doi: 10.1038/nmeth.3630. Epub 2015 Oct. 26. |
| pHAGE EF1α dCas9-KRAB | dCas9 (Other) | EF1alpha | Puromycin | Cas9 effector-mediated regulation of transcription and differentiation in human pluripotent stem cells.Development. 2014 January; 141(1): 219-23. doi: 10.1242/dev.103341. |
| Cas9m4 | Cas9m4 (Other) | | | CAS9 transcriptional activators for target specificity screening and paired nickases for cooperative genome engineering. Nat Biotechnol. 2013 Aug. 1. doi: 10.1038/nbt.2675. |
| pHAGE TRE dCas9-KRAB | dCas9 (Other) | TRE | Neomycin (select with G418) | Cas9 effector-mediated regulation of transcription and differentiation in human pluripotent stem cells.Development. 2014 January; 141(1): 219-23. doi: 10.1242/dev.103341. |
| pSLQ1658-dCas9-EGFP | dCas9 fuse to EGFP (*Homo sapiens*) | MSCV LTR promoter | Puromycin | Dynamic Imaging of Genomic Loci in Living Human Cells by an Optimized CRISPR/Cas System. Cell. 2013 Dec. 19; 155(7): 1479-91. doi: 10.1016/j.cell.2013.12.001. |
| pHR-SFFV-dCas9-BFP | dCas9-BFP fusion (*Homo sapiens*) | SFFV | | CRISPR-Mediated Modular RNA-Guided Regulation of Transcription in Eukaryotes. Cell. 2013 Jul. 9. pii: S0092-8674(13)00826-X. doi: 10.1016/j.cell.2013.06.044. |
| pLV hUbC-dCas9-T2A-GFP | humanized dead Cas9 T2A GFP (Other) | hUbC | Zeocin | Multiplex CRISPR/Cas9-based genome engineering from a single lentiviral vector. Nucleic Acids Res. 2014 Aug. 13. pii: gku749. |
| Bacteria | | | | |
| pdCas9-bacteria | dCas9 (bacteria) (Other) | pLtetO-1 | — | Repurposing CRISPR as an RNA-Guided Platform for Sequence-Specific Control of Gene Expression. Cell. 2013 Feb. 28; 152(5): 1173-83. doi: 10.1016/j.cell.2013.02.022. |

TABLE 1-continued

Non-limiting list of dCas9 Vectors

| Plasmid | Gene/Insert | Promoter | Selectable Marker | Publication |
|---|---|---|---|---|
| pdCas9 | tracrRNA (Other), dcas9 (Other), CRISPR array | | — | Programmable repression and activation of bacterial gene expression using an engineered CRISPR-Cas system. Nucleic Acids Res. 2013 Jun. 12. |
| pMJ841 | Cas9 (Other) | T7 | — | A Programmable Dual-RNA-Guided DNA Endonuclease in Adaptive Bacterial Immunity. Science. 2012 Jun. 28. |
| pET302-6His-dCas9-Halo | His6-dCas9-Halo (Synthetic) | | — | CASFISH: CRISPR/Cas9-mediated in situ labeling of genomic loci in fixed cells. Proc Natl Acad Sci U S A. 2015 Sep. 22; 112(38): 11870-5. doi: 10.1073/pnas.1515692112. Epub 2015 Aug. 31. |
| 10xHis-MBP-TEV-S. pyogenes dCas9 M1C D10A C80S H840A C574S | dCas9 M1C D10A C80S H840A C574S (Other) | | — | Programmable RNA recognition and cleavage by CRISPR/Cas9. Nature. 2014 Sep. 28. doi: 10.1038/nature13769. |
| pJMP1 | dCas9 (Other) | xylA | — | A Comprehensive, CRISPR-based Functional Analysis of Essential Genes in Bacteria. Cell. 2016 Jun. 2; 165(6): 1493-506. doi: 10.1016/j.cell.2016.05.003. Epub 2016 May 26. |
| pCRISPathBrick | | Constitutive native promoters | — | CRISPathBrick: Modular Combinatorial Assembly of Type II-A CRISPR Arrays for dCas9-Mediated Multiplex Transcriptional Repression in *E. coli*. ACS Synth Biol. 2015 Mar. 30. |
| pZ8-T_dCas9 | dcas9 | ptac | — | *Corynebacterium glutamicum* Metabolic Engineering with CRISPR Interference (CRISPRi). ACS Synth Biol. 2016 Feb. 16. |
| DS-SPcasN- | Cas9, nuclease-null (Other), tracrRNA precursor (Other) | proC, tracdrRNA promoter | — | Orthogonal Cas9 proteins for RNA-guided gene regulation and editing. Nat Methods. 2013 Sep. 29. doi: 10.1038/nmeth.2681. |
| pSET-dCas9-actII-4-NT-S1 | dCas9 (Synthetic), sgRNA | ermE*p, J23119 | — | CRISPR/dCas9-Mediated Multiplex Gene Repression in *Streptomyces*. Biotechnol J. 2018 Jun. 3. doi: 10.1002/biot.201800121. |
| Yeast | | | — | |
| pTDH3-dCas9-Mxi1 | dCas9-Mxi1 | TDH3 | LEU2 | CRISPR-Mediated Modular RNA-Guided Regulation of Transcription in Eukaryotes. Cell. 2013 Jul. 9. pii: S0092-8674(13)00826-X. doi: 10.1016/j.cell.2013.06.044. |
| pTDH3-dCas9 | dCas9 | TDH3 | LEU2 | CRISPR-Mediated Modular RNA-Guided Regulation of Transcription in Eukaryotes. Cell. 2013 Jul. 9. pii: S0092-8674(13)00826-X. doi: 10.1016/j.cell.2013.06.044. |
| pRS416-dCas9-Mxi1 + TetR + pRPR1(TetO)-NotI-gRNA | dCas9-Mxi1 (Synthetic), Tet Repressor (Other), | pTef1, pGPM1, pRPR1(TetO) | URA3 | Quantitative CRISPR interference screens in yeast identify chemical-genetic interactions and new rules |

TABLE 1-continued

Non-limiting list of dCas9 Vectors

| Plasmid | Gene/Insert | Promoter | Selectable Marker | Publication |
| --- | --- | --- | --- | --- |
| | Structural gRNA for S pyogenes (Synthetic) | | | for guide RNA design. Genome Biol. 2016 Mar. 8; 17(1): 45. doi: 10.1186/s13059-016-0900-9. |
| pCRISPRi_Mxi1_yl_NHEJ | Codon optimized dCas9-Mxi1 (Synthetic), KU70 sgRNA expression cassette (Synthetic), KU80a sgRNA expression cassette (Synthetic), KU80b sgRNA expression cassette (Synthetic) | UAS1B8-TEF(136), SCR1'-tRNA, SCR1'-tRNA, SCR1'-tRNA | LEU2 | CRISPRi repression of nonhomologous end-joining for enhanced genome engineering via homologous recombination in *Yarrowia lipolytica*.Biotechnol Bioeng. 2017 Aug. 19. doi: 10.1002/bit.26404. |
| pCRISPRi_Mxi1_yl | Codon optimized dCas9-Mxi1 (Synthetic), sgRNA expression cassette (Synthetic) | UAS1B8-TEF(136), SCR1'-tRNA | LEU2 | CRISPRi repression of nonhomologous end-joining for enhanced genome engineering via homologous recombination in *Yarrowia lipolytica*.Biotechnol Bioeng. 2017 Aug. 19. doi: 10.1002/bit.26404. |
| pTPGI_dCas9 | Yeast-optimized dCas9 (*Saccharomyces cerevisiae*) | pTPGI | TRP1 | Tunable and Multifunctional Eukaryotic Transcription Factors Based on CRISPR/Cas.ACS Synth Biol. 2013 Sep. 11. |
| pJZC518 | dCas9 (Other) | pTdh3 | LEU2 | Engineering Complex Synthetic Transcriptional Programs with CRISPR RNA Scaffolds. Cell. 2014 Dec. 18. pii: S0092-8674(14)01570-0. doi: 10.1016/j.cell.2014.11.052. |

CRISPR/Cpf1

In other embodiments, the present disclosure teaches methods of gene editing using a Type V CRISPR system. In some embodiments, the present disclosure teaches methods of using CRISPR from *Prevotella* and *Francisella* 1 (Cpf1).

The Cpf1 CRISPR systems of the present disclosure comprise i) a single endonuclease protein, and ii) a crRNA, wherein a portion of the 3' end of crRNA contains the guide sequence complementary to a target nucleic acid. In this system, the Cpf1 nuclease is directly recruited to the target DNA by the crRNA (see solid triangle arrows in FIG. 1B). In some embodiments, guide sequences for Cpf1 must be at least 12 nt, 13 nt, 14 nt, 15 nt, or 16 nt in order to achieve detectable DNA cleavage, and a minimum of 14 nt, 15 nt, 16 nt, 17 nt, or 18 nt to achieve efficient DNA cleavage.

The Cpf1 systems of the present disclosure differ from Cas9 in a variety of ways. First, unlike Cas9, Cpf1 does not require a separate tracrRNA for cleavage. In some embodiments, Cpf1 crRNAs can be as short as about 42-44 bases long—of which 23-25 nt is guide sequence and 19 nt is the constitutive direct repeat sequence. In contrast, the combined Cas9 tracrRNA and crRNA synthetic sequences can be about 100 bases long. In some embodiments, the present disclosure will refer to a crRNA for Cpf1 as a "guide RNA."

Second, Cpf1 prefers a "TTN" PAM motif that is located 5' upstream of its target. This is in contrast to the "NGG" PAM motifs located on the 3' of the target DNA for Cas9 systems. In some embodiments, the uracil base immediately preceding the guide sequence cannot be substituted (Zetsche, B. et al. 2015. "Cpf1 Is a Single RNA-Guided Endonuclease of a Class 2 CRISPR-Cas System" Cell 163, 759-771, which is hereby incorporated by reference in its entirety for all purposes).

Third, the cut sites for Cpf1 are staggered by about 3-5 bases, which create "sticky ends" (Kim et al., 2016. "Genome-wide analysis reveals specificities of Cpf1 endonucleases in human cells" published online Jun. 6, 2016). These sticky ends with ~3-5 nt overhangs are thought to facilitate NHEJ-mediated-ligation, and improve gene editing of DNA fragments with matching ends. The cut sites are in the 3' end of the target DNA, distal to the 5' end where the PAM is. The cut positions usually follow the 18th base on the non-hybridized strand and the corresponding 23rd base on the complementary strand hybridized to the crRNA (FIG. 1B).

Fourth, in Cpf1 complexes, the "seed" region is located within the first 5 nt of the guide sequence. Cpf1 crRNA seed regions are highly sensitive to mutations, and even single base substitutions in this region can drastically reduce cleavage activity (see Zetsche B. et al. 2015 "Cpf1 Is a Single RNA-Guided Endonuclease of a Class 2 CRISPR-Cas System" Cell 163, 759-771). Critically, unlike the Cas9 CRISPR target, the cleavage sites and the seed region of Cpf1 systems do not overlap. Additional guidance on designing Cpf1 crRNA targeting oligos is available on (Zetsche B. et al. 2015. "Cpf1 Is a Single RNA-Guided Endonuclease of a Class 2 CRISPR-Cas System" Cell 163, 759-771).

Persons skilled in the art will appreciate that the Cpf1 disclosed herein can be any variant derived or isolated from any source. For example, in some embodiments, the Cpf1 peptide of the present disclosure can include one or more of SEQ ID Nos selected from SEQ ID NO: 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, or any variants thereof.

The present disclosure further envisions the use of catalytically inactivated Cpf1 mutants, as described in further detail in later sections of this document. Thus in some embodiments, the present disclosure teaches dCpf1 mutants. In some embodiments, the dCpf1 of the present disclosure comprises: ddCpf1 (Zhang et al. "Multiplex gene regulation by CRISPR ddCpf1" Cell Discovery 3, Article number 17018 (2017); *Francisella novicida* (UniProtKB-A0Q7Q2 (CPF1_FRATN)), Lachnospiraceae bacterium (UniProtKB-A0A182DWE3 (A0A182DWE3_9FIRM)), and *Acidaminococcus* sp. (UniProtKB-U2UMQ6 (CPF1 ACISB). In some embodiments, the dCpf1 of the present disclosure is generated by mutating the catalytic domain AsCpf1 (D908A Yamano, T., Nishimasu, H., Zetsche, B., Hirano, H., Slaymaker, I. M., Li, Y., Fedorova, I., Nakane, T., Makarova, K. S., Koonin, E. V. et al. (2016) Crystal Structure of Cpf1 in Complex with Guide RNA and Target DNA. *Cell*, 165, 949-962.

Ligases

In some embodiments, the present disclosure teaches methods of cleaving target DNA via targeted Cpf1 complexes, and then ligating the resulting sticky ends with DNA inserts. In some embodiments, the present disclosure teaches methods of providing a Cpf1 complex to cleave the target DNA, and a ligase to "sew" the DNA back together. In other embodiments, the present disclosure teaches modified Cpf1 complexes that include a tethered ligase enzyme.

As used herein, the term "ligase" can comprise any number of enzymatic or non-enzymatic reagents. For example, ligase is an enzymatic ligation reagent or catalyst that, under appropriate conditions, forms phosphodiester bonds between the 3'-OH and the 5'-phosphate of adjacent nucleotides in DNA molecules, RNA molecules, or hybrids.

In some embodiments, the present disclosure teaches the use of enzymatic ligases. Compatible temperature sensitive enzymatic ligases, include, but are not limited to, bacteriophage T4 ligase and *E. coli* ligase. Thermostable ligases include, but are not limited to, Afu ligase, Taq ligase, Tfl ligase, Tth ligase, Tth HB8 ligase, *Thermus* species AK16D ligase and Pfu ligase (see for example Published P.C.T. Application WO/2000/026381, Wu et al., Gene, 76(2):245-254, (1989), and Luo et al., Nucleic Acids Research, 24(15): 3071-3078 (1996)). The skilled artisan will appreciate that any number of thermostable ligases can be obtained from thermophilic or hyperthermophilic organisms, for example, certain species of eubacteria and archaea; and that such ligases can be employed in the disclosed methods and kits. In some embodiments, reversibly inactivated enzymes (see for example U.S. Pat. No. 5,773,258) can be employed in some embodiments of the present teachings.

In other embodiments, the present disclosure teaches the use of chemical ligation agents. Chemical ligation agents include, without limitation, activating, condensing, and reducing agents, such as carbodiimide, cyanogen bromide (BrCN), N-cyanoimidazole, imidazole, 1-methylimidazole/carbodiimide/cystamine, dithiothreitol (DTT) and ultraviolet light. Autoligation, i.e., spontaneous ligation in the absence of a ligating agent, is also within the scope of the teachings herein. Detailed protocols for chemical ligation methods and descriptions of appropriate reactive groups can be found in, among other places, Xu et al., Nucleic Acid Res., 27:875-81 (1999); Gryaznov and Letsinger, Nucleic Acid Res. 21:1403-08 (1993); Gryaznov et al., Nucleic Acid Res. 22:2366-69 (1994); Kanaya and Yanagawa, Biochemistry 25:7423-30 (1986); Luebke and Dervan, Nucleic Acids Res. 20:3005-09 (1992); Sievers and von Kiedrowski, Nature 369:221-24 (1994); Liu and Taylor, Nucleic Acids Res. 26:3300-04 (1999); Wang and Kool, Nucleic Acids Res. 22:2326-33 (1994); Purmal et al., Nucleic Acids Res. 20:3713-19 (1992); Ashley and Kushlan, Biochemistry 30:2927-33 (1991); Chu and Orgel, Nucleic Acids Res. 16:3671-91 (1988); Sokolova et al., FEBS Letters 232:153-55 (1988); Naylor and Gilham, Biochemistry 5:2722-28 (1966); and U.S. Pat. No. 5,476,930.

In some embodiments, the methods, kits and compositions of the present disclosure are also compatible with photoligation reactions. Photoligation using light of an appropriate wavelength as a ligation agent is also within the scope of the teachings. In some embodiments, photoligation comprises probes comprising nucleotide analogs, including but not limited to, 4-thiothymidine, 5-vinyluracil and its derivatives, or combinations thereof. In some embodiments, the ligation agent comprises: (a) light in the UV-A range (about 320 nm to about 400 nm), the UV-B range (about 290 nm to about 320 nm), or combinations thereof, (b) light with a wavelength between about 300 nm and about 375 nm, (c) light with a wavelength of about 360 nm to about 370 nm; (d) light with a wavelength of about 364 nm to about 368 nm, or (e) light with a wavelength of about 366 nm. In some embodiments, photoligation is reversible. Descriptions of photoligation can be found in, among other places, Fujimoto et al., Nucl. Acid Symp. Ser. 42:39-40 (1999); Fujimoto et al., Nucl. Acid Res. Suppl. 1:185-86 (2001); Fujimoto et al., Nucl. Acid Suppl., 2:155-56 (2002); Liu and Taylor, Nucl. Acid Res. 26:3300-04 (1998) and on the world wide web at: sbchem.kyoto-u.ac.jp/saito-lab.

Universal Modular CRISPR DNA Constructs and Uses Thereof

In some embodiments, the present invention describes a strategy for the modular assembly of DNA constructs. In some embodiments, the DNA assembly methods of the present disclosure are applicable to any construct, including plasmids, small linear DNA, and transformed chromosomal loci.

In aspects, the inventors refer to such a universal modular CRISPR DNA Construct as a "MegaModular" design.

Shortcomings in Traditional DNA Editing and Assembly Techniques

Traditional multicomponent DNA cloning strategies are limited in their ability to effectively assemble and modify multi-component DNA constructs with complex sequences. For example, restriction enzyme cloning is limited by the availability of unique restriction enzyme recognition sites that are appropriately located at the cloning junctures at each of the DNA inserts, and their destination sites within a final vector. Gateway cloning technologies are similarly limited by the relatively small number of unique recombination sites available for multi-component assemblies.

Another downside to traditional DNA assembly techniques is that their ability to edit sequences is often restricted to the time of construction. For example, the products of efficient assembly strategies such as Ligase Cycling Reactions (LCR are not easily modified once the initial assembly is completed (Kok, S, et al., 2014 "Rapid and Reliable DNA assembly via Ligase Cycling Reaction" ACS Synth. Biol., 3 (2): 97-106). Similar concerns arise with traditional restriction enzyme cloning, whose common restriction recognition sites cease to function as unique cloning points once a polynucleotide containing the restriction sites is inserted into the construct being assembled, or when said construct is integrated into a chromosome full of said sites. Vectors produced through sequential restriction cloning thus provide very few options for fixing or updating sequences once the cloning process is well under way.

Even newer technologies, such as the traditional CRISPR DNA assembly techniques continue to suffer from similar complexity, the ease of iterating on a previous assembled construct/vector design, and speed limitations (Wang, J W. et al., 2015 "CRISPR/Cas9 nuclease combined with Gibson assembly for seamless cloning" BioTechniques, Vol 58, No. 4:161-170). CRISPR cloning requires the design of a functional guide RNA targeted next to a compatible protospacer adjacent motif (PAM). Availability of suitable PAM sequences within target sites results in a significant design limitation to the number of possible DNA insertion locations within a genome or construct.

Moreover, the design and testing of guide RNA sequences imposes significant technical challenges for multi-component assemblies. Persons having skill in the art will recognize for example, that not all gRNA sequences are functional, and that effective implementation of a CRISPR DNA assembly may sometimes require the design and validation of multiple gRNA sequence variants. These limitations are particularly cumbersome in multi-component assemblies, where failure of a single gRNA sequence to successfully produce a desired modification can trigger the need to redesign subsequent assembly components that no longer fall within the original cloning plan. Applying techniques that require multiple custom guide RNAs for every junction of a multicomponent assembly can thus also be very expensive, cumbersome, and impractical.

Modular CRISPR Tag Assembly Vectors and Methods of Using Such

In some embodiments, the present disclosure teaches methods for DNA assembly that overcome many of the limitations associated with the aforementioned traditional techniques described above. In some embodiments, the present disclosure also teaches modular CRISPR assembly constructs, compositions, and kits for use with the methods of the present invention.

In some embodiments, the present disclosure teaches DNA constructs comprising one or more CRISPR multiclonal sites (cMCS). In some embodiments, the cMCS of the present disclosure represent only a portion of the DNA constructs described (i.e., only a portion of the construct is readily editable according to the methods of the present disclosure). In other embodiments, the cMCS of the present disclosure are located on key positions within the entire construct, such that the entire DNA construct is readily editable. Thus, in some embodiments all the functional parts of the modular cTAG vectors (e.g., all origins, markers, cargo, elements required for assembly) are comprised within insert DNA parts and can be readily exchanged via the gene editing methods of the present disclosure.

In some embodiments, the cMCS of the present disclosure comprise one or more cloning tags (cTAG), each comprising at least one validated CRISPR targeting site. In some embodiments, the cMCS of the present disclosure further comprises DNA insert parts, each flanked by a pair of cTAGs, such that digestion of the cMCS with one or more CRISPR endonuclease targeting one or more cTAGs, will release said flanked insert part, allowing for insertion of a compatible donor DNA part.

FIGS. 2 and 3 of this specification illustrate an embodiment of a modular CRISPR assembly plasmid construct, according to the methods of the present disclosure. The disclosed example plasmid contains a series of DNA insertions (Parts 1-8 in FIG. 2A), each flanked by a pair of cTAGs (Tags A-H) in FIG. 2A. Digestion of cTAGs A and B of this example with the appropriate CRISPR/guide sequence complexes will release Part 2 of the plasmid, allowing for insertion of a replacement part 2 insert with the desired characteristics.

Persons having skill in the art will immediately recognize the advantages of the presently described vector system, which allows for the sequence-specific modular cloning/editing of vectors in vivo and in vitro. The sections below will outline the various aspects of the disclosed modular cloning vectors, as well as their various applications to molecular biology, gene therapy, and gene editing.

Modular CRISPR Vector Insert Parts

In some embodiments, the insert parts of the present disclosure are donor DNA sequences for homologous recombination insertion following a CRISPR digestion. Thus, in some embodiments, insert part sequences of the present disclosure comprise an insert sequence of interest, flanked by sequences with sufficient homology to the ends of the digested modular CRISPR construct, so as to trigger homologous recombination, hybridization and insertion of the sequence.

In other embodiments, the insert parts of the present disclosure are donor DNA sequences capable of hybridizing and ligation via sticky ends (e.g., following a Cpf1 digestion, restriction enzyme digestion, Gibson assembly, or other hybridization-based assembly, including LCR). Thus, in some embodiments, insert part sequences of the present disclosure comprise an insert sequence of interest, flanked by sequences with sufficient homology to the ends of the digested modular CRISPR construct, so as to allow for hybridization of sticky ends.

In yet other embodiments, the insert parts of the present disclosure are donor DNA sequences for blunt end ligation.

In some embodiments, the modular CRISPR DNA constructs of the present disclosure are compatible with any insert part sequence. Thus, the parts of the present vectors can comprise, without limitation, selectable markers, origins of replication, promoters, terminator sequences; other regulatory sequences, barcodes, recombination sites, or other sequences of interest to the user. In some embodiments, the insert parts of the present disclosure can comprise homology sequences for triggering homologous recombination and insertion into one or more genetic loci. In some embodiments, said homologous recombination insert parts will precede and follow other insert parts that will be also be inserted into the genome via the recombination event.

In some embodiments, the present disclosure teaches that each insert part comprises a single sequence (e.g., only a promoter or only a gene of interest, see FIG. 2A, part 8). In other embodiments, the present disclosure teaches that one or more insert parts may contain multiple elements, such as promoter-gene of interest (GOI) combinations, multi-subunit chimeric protein fusions, or even entire constructs (see FIG. 2A, part 5, comprising a promoter-GOI-terminator combination).

In some embodiments, the present disclosure teaches uncombined individual insert parts. That is, in some embodiments, the present disclosure teaches one or a plurality of unconnected insert parts (see FIG. 2A, right side showing a list of uncombined insert parts). In some embodiments, the present disclosure teaches methods of assembling said plurality of parts into one or more modular CRISPR constructs. In some aspects, the disclosure teaches kits for assembling a MegaModular construct.

In other embodiments, the present disclosure teaches partial- or fully-assembled modular CRISPR DNA constructs. For example, in some embodiments the present disclosure teaches modular CRISPR DNA constructs comprising 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, or more assembled insert parts, and any ranges therebetween. The disclosure also teaches kits comprising said insert parts.

In some embodiments, said assembled or partially assembled modular CRISPR DNA constructs are linear. In some embodiments, said assembled or partially assembled modular CRISPR DNA constructs are circular (e.g., a plasmid). In some embodiments, said assembled or partially assembled modular CRISPR DNA constructs are integrated into genomic DNA.

Figure 3C:
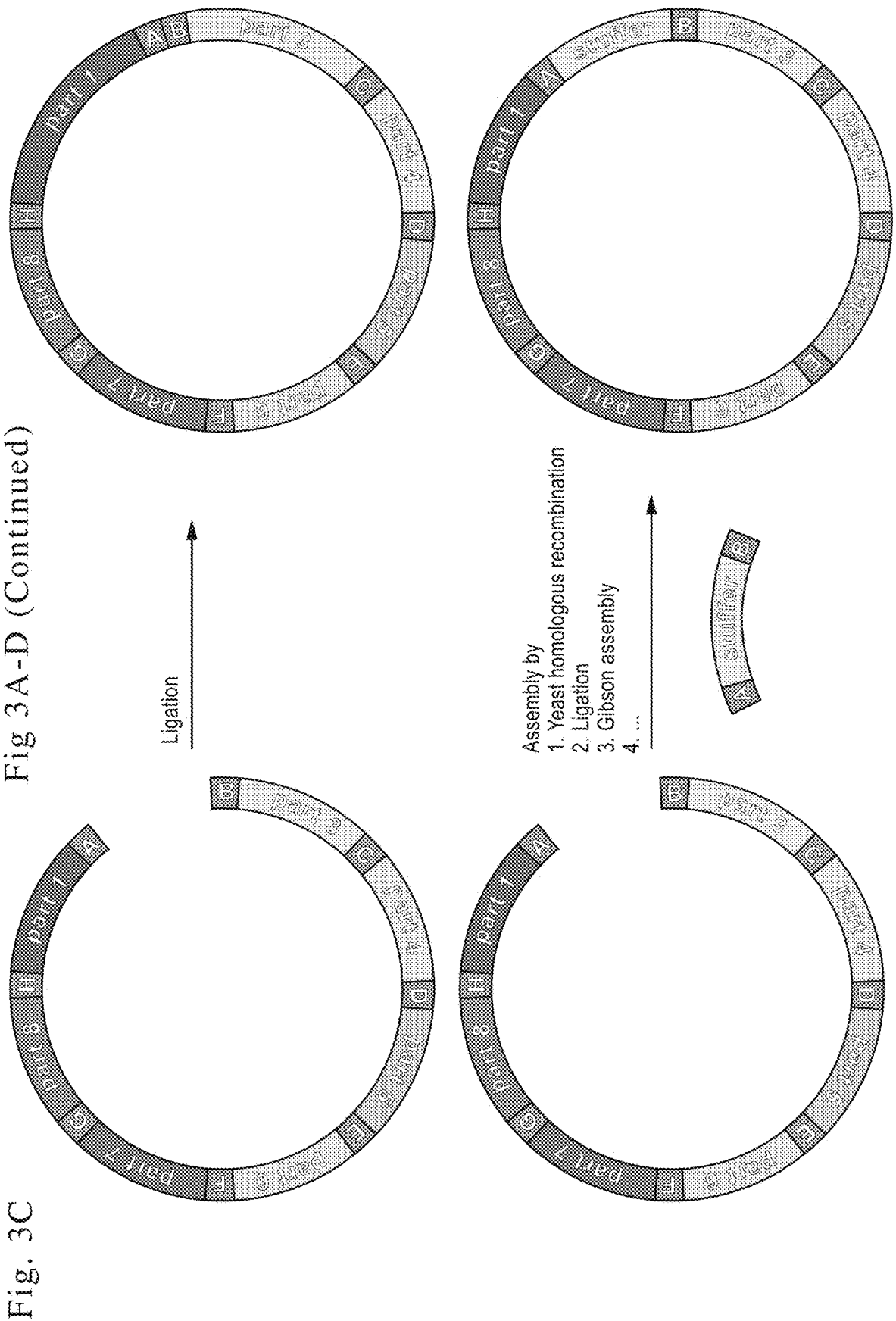
FIG. 3C—Illustrates methods of the present disclosure for removing insert parts, or for adding stuffer sequences from existing modular plasmids.

In some embodiments, the constructs of the present disclosure will initially contain only short spacer sequences as placeholders for further cloning (see "stuffer" sequence in FIG. 3C). In some embodiments, the insert part placeholders are small, randomized sequences. In other embodiments, the vectors of the present disclosure will initially comprise one or more pre-selected insert DNA parts. For example, in some embodiments, the modular CRISPR constructs will initially comprise at least one selection marker, and/or at least one origin of replication.

Suitable selectable markers include, but are not limited to, genes that confer antibiotic resistance, genes that encode fluorescent proteins, tRNA genes, auxotrophic markers, toxic genes, phenotypic markers, antisense oligonucleotides, restriction endonucleases, restriction endonuclease cleavage sites, enzyme cleavage sites, protein binding sites, and sequences complementary to PCR primer sequences.

Suitable antibiotic resistance genes include, but are not limited to, a chloramphenicol resistance gene, an ampicillin resistance gene, a tetracycline resistance gene, a Zeocin resistance gene, a spectinomycin resistance gene and a kanamycin resistance gene.

In certain embodiments of the present invention, the counterselectable marker is a toxic gene. Suitable toxic genes include, but are not limited to, a ccdB gene, a gene encoding a tus protein which binds one or more ter sites, a kicB gene, a sacB gene, an ASK1 gene, a ΦX174 E gene and a DpnI gene. In some embodiments, the presence of a toxic selectable marker serves as an indicator that an insertion was not conducted, or was unsuccessful. Toxic selectable markers may also serve to decrease background of unmodified parent vectors of positive cells, by causing death to cells harboring unmodified vectors with the toxic gene still in place.

In additional embodiments of the methods of the present invention, the modular CRISPR constructs may comprise both one or more toxic genes and one or more antibiotic resistance genes.

In some embodiments, the modular CRISPR constructs will initially comprise at least one regulatory sequence. In some embodiments, the present disclosure teaches vectors comprising, without limitation, Matrix Attachment Regions, expression insulator sequences, expression enhancer sequences, promoters, 5' UTRs, 3' UTRs, terminator sequences, stop codons, start codons, etc. In some embodiments, the modular CRISPR constructs will initially comprise sequences for facilitating chromosomal insertion of said construct (e.g., t-DNA borders, Cre/Lox, or homology ends to chromosomal sequences). In some embodiments, the sequences for chromosomal insertion are positioned so as to insert the entire modular CRISPR construct into the genome of an organism. In other embodiments, the sequences for chromosomal insertion are positioned so as to insert only a portion of the modular CRISPR construct (see FIG. 3D).

In some embodiments, the insert parts of the present disclosure can even comprise additional cTAGs. The addition of cTAGs, through insert parts, can increase the complexity of available cloning schemes, and can also expand the size of the construct by expanding the number of available insert parts that can be replaced.

In some embodiments, the insert parts of the present disclosure can comprise a traditional cloning site. For example, in some embodiments, the present disclosure teaches insert parts comprising gateway recombination sites, restriction sites, Cre/Lox sites, or other traditional cloning sites). In some embodiments, the insert parts of the present disclosure can comprise sequences for golden gate cloning. In some embodiments, the insert parts of the present disclosure can comprise sequences for traditional restriction enzyme cloning. In other embodiments, the insert parts of the present disclosure can comprise sequences for gateway cloning.

In some embodiments, the present disclosure teaches methods of producing insert parts from traditional DNA constructs. That is, in some embodiments, the present disclosure teaches methods of adding cTAGs to traditional DNA constructs (e.g., to oligos, PCR fragments, plasmids, or other available DNA segment). In some embodiments, the present disclosure teaches methods of adding cTAGs to a single component, such as a gene of interest (GOI), promoter. In other embodiments, the present disclosure teaches methods of adding cTAGS to multi-element constructs.

In some embodiments, the present disclosure teaches the use of DNA barcodes. In some embodiments, the barcodes of the present disclosure are unique series of DNA nucleotides, that, when present in a DNA vector, can be used to look up information about the vector in a database. In some embodiments, presence of the vector can be associated in the database with a history of the vector, including the source for various components, and when the vector was produced and by whom. The barcode can also be used to distinguish otherwise identical pieces of DNA, such as when necessary for molecular counting, or other similar applications.

In some embodiments, the barcodes of the present disclosure can be associated with a whole vector. In other embodiments, the present disclosure teaches the integration of barcodes into insert parts. In some embodiments, the barcodes of the present disclosure are in one or more cTAGs. In specific embodiments, the barcode in an insert part can be used to label different CRISPR enzymes or guide RNAs encoded by the insert part. In some embodiments, sequencing the barcode can provide information that would otherwise require the sequencing of the entire insert part or entire vector/construct.

Persons having skill in the art will recognize methods for constructing insert parts. For example, in some embodiments, the cTAGs may be incorporated into a DNA molecule via PCR amplification with primers comprising said cTAGs. In other embodiments, the cTAGs may be incorporated via traditional cloning techniques (e.g., restriction enzymes, Gibson, or other assembly method). In yet other embodiments, the cTAGs can be incorporated via blunt-end ligation.

In some embodiments, the insert parts of the present disclosure can have a wide species compatibility spectrum (e.g., a marker may contain both prokaryotic and eukaryotic expression sequences to make it effective in multiple organisms). In other embodiments, the insert parts of the present disclosure are designed to have limited applicability to organisms within a single species/genus/family/order/class/phylum/kingdom or domain. In some embodiments for example, an origin of replication part may be capable of maintaining a plasmid in only a single species, or a group of species. In other embodiments, a fluorescent marker may be codon optimized to function across both prokaryotic and eukaryotic domains.

In some embodiments, Cas9 endonucleases cleave 3-4 nucleotides upstream from the PAM of a target sequence. cTAG digestion by a Cas9 complex can thus result in loss of cTAG functionality through the loss of the PAM sequence, or protospacer sequence of the target. In some embodiments, the present disclosure teaches methods of maintaining the functionality of said cTAG sequences by designing donor insert sequences such that they reconstitute the cTAG sequence upon insertion (e.g., through insertion of the previously lost PAM or protospacer sequence). Similar provisions are envisioned for sequences cleaved through Cpf1 endonucleases.

Figures 2B, 2C:
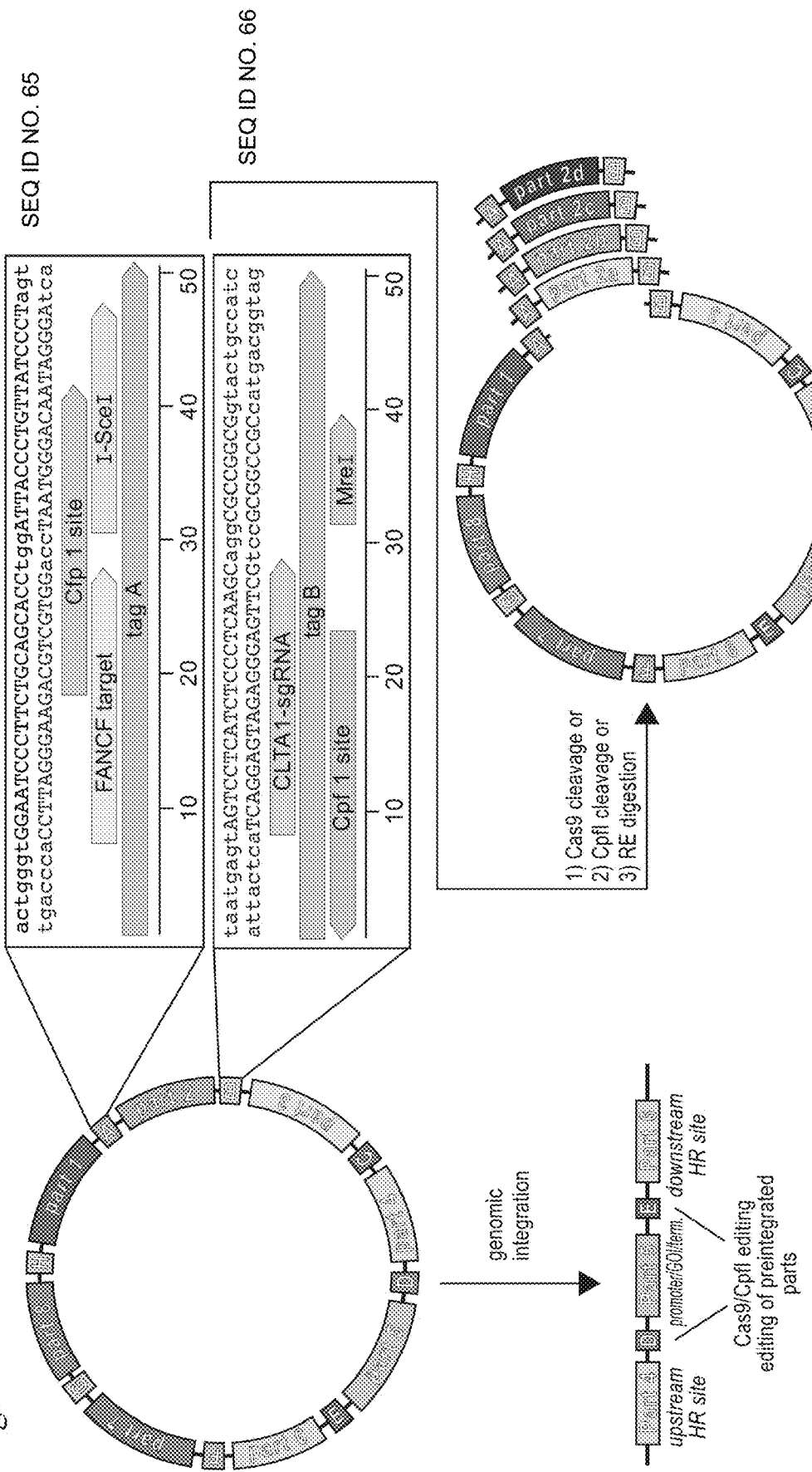
FIG. 2B—Several strategies such as Cas9, Cpf1, or restriction endonuclease cleavage at cTAGs may be used to replace individual parts without having to reassemble the entire plasmid. cTAG sequences may comprise one or more cloning sites, including, but not limited to Cas9, Cpf1, restriction, and/or recombination sites.
FIG. 2C—Once integrated into the genome of an organism, cTAGs may continue to serve as pre-validated Cas9 or Cpf1 landing sites, enabling replacement, insertion, or removal of genomically integrated DNA with prevalidated and orthogonal gRNA sequences.
Figure 3D:
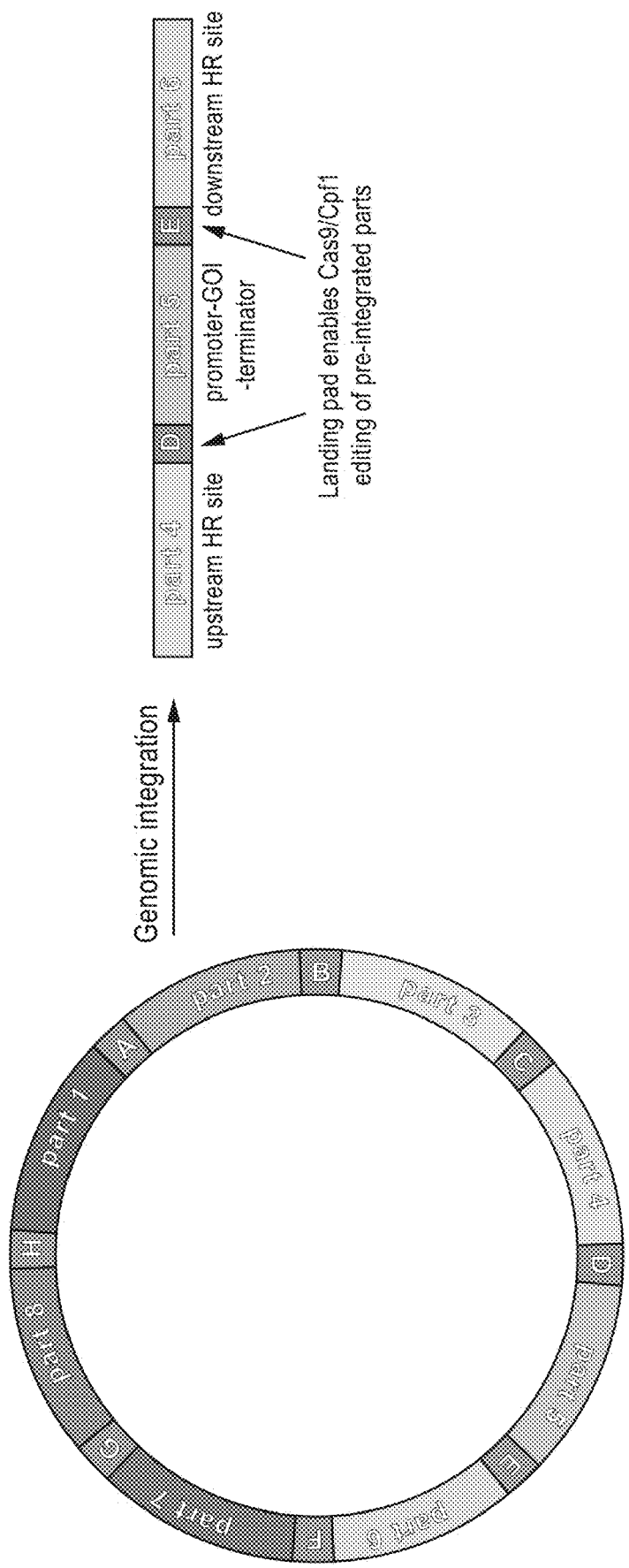
FIG. 3D—Insert parts of the modular plasmids of the present disclosure may serve as sequences for genomic integration of a portion or the whole of the modular CRISPR vectors into the genome of a host cell.

FIG. 2B illustrates the presently disclosed concept of cTAG repair. Cleavage of insert part 2 with a Cas9 endonuclease also results in loss of a portion of cTAGs A and B. Subsequent insertions of any one of insert parts 2a-2d via homologous recombination results in a restoration of the full cTAG sequence.

Persons having skill in the art will recognize the nearly infinite options for insert parts. The foregoing list of inserts was intended as illustrative, and should in no way be construed as limiting the applicability of the presently disclosed methods, kits, and constructs.

In some embodiments, the insert parts of the present disclosure can themselves encode for a CRISPR enzyme, catalytically inactivated CRISPR enzyme, or a putative CRISPR enzyme.

As used herein, the term "putative CRISPR enzyme" refers to proteins that are believed to be capable of exhibiting CRISPR-like function in vitro, or in a host cell. Persons having skill in the art will recognize the various ways in which a peptide could be categorized as a putative CRISPR enzyme. In some embodiments, a putative CRISPR enzyme will be categorized as such based on sequence or structural homology with one or more known CRISPR enzymes. In other embodiments, putative CRISPR enzymes will be categorized based on their ability to interact with one or more guide RNAs. In other embodiments, putative CRISPR enzymes will be categorized based on the results of genetic screens of gain or loss of function libraries in which the DNA encoding the enzyme is found to affect CRISPR immunity of a host cell. Thus, in some embodiments, the presently disclosed modular vectors can be used to screen putative CRISPR enzyme libraries to identify valuable enzymes with CRISPR activity in one or more host cell. In some embodiments, the present disclosure teaches high throughput methods for validating putative CRISPR enzymes by testing them in combination with one or more guide RNA sequences and measuring the degree of target cleavage. Target cleavage can be measured via any method known to persons having skill in the art, including by measuring loss of expression of a target gene, or measuring digestion by e.g., running digested products on a gel, sequencing digested products, or running PCR reactions designed to amplify only undigested target DNA.

Modular CRISPR Cloning Tags

In some embodiments, the modular CRISPR constructs of the present disclosure comprise one or more cloning tags (cTAGs). In some embodiments, the modular CRISPR constructs of the present disclosure comprise 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more cTAGs.

In some embodiments, the present disclosure teaches that each cTAG comprises at least one validated CRISPR protospacer/PAM combination sequence ("CRISPR landing site"). That is, in some embodiments, cTAGs comprise at least one experimentally validated, high efficiency CRISPR landing site. In some embodiments, the cTAGs of the present disclosure may be validated by wet bench experimentation (e.g., in vitro cleavage of the cTAG sequence with a CRISPR complex targeting said CRISPR landing site). In other embodiments, the cTAG validation may be assumed from reports of cleavage in peer-reviewed journals.

In some embodiments, the cTAGs of the present disclosure comprise 1, 2, 3, 4, 5, 6, 7, 8, 9, 10, or more CRISPR landing sites. In some embodiments, the CRISPR landing sites overlap with each other. In other embodiments, the CRISPR landing sites occupy distinct non-overlapping regions within the cTAG. In some embodiments, the CRISPR landing sites can be specific for either Cas9 or Cpf1 endonuclease cleavage. In some embodiments, the CRISPR landing sites can be specific to any other current or yet to be discovered CRISPR endonuclease.

In other embodiments, the present disclosure teaches that multiple cloning sites in a single cTAG can be designed to function across different organisms. Thus in some embodiments, cTAG Cpf1 landing sites may be preferred in organisms lacking or downregulating HR machinery. In other embodiments, restriction sites of a cTAG may be preferred for initial in vitro cloning, while Cas9 or Cpf1 landing sites may be preferred for more complex editing occurring in vivo in selected eukaryotic organisms.

In some embodiments, the present disclosure teaches that cTAGs may comprise one or more non-CRISPR cloning sequences. For example, in some embodiments, the cTAGs of the present disclosure may comprise one or more elements selected from the group consisting of a restriction enzyme site, a recombination site, a topoisomerase site, a splicing site, and a Cre-Lox site.

In some embodiments, suitable restriction enzyme sites include, without limitation, sites recognized by restriction enzymes selected from the group consisting of AaII, AarI, AasI, AatII, Acc65I, AccB7I, AccI, AccIII, AciI, AclI, AcuI, AdeI, AfeI, AflII, AflIII, AgeI, AhdI, AleI, AloI, AluI, Alw21I, Alw26I, Alw44I, AlwI, AlwNI, ApaI, ApaLI, ApeKI, ApoI, AscI, AseI, AsiSI, AvaI, AvaII, AvrII, BaeI, BalI, BamHI, BanI, BanII, BbsI, BbuI, BbvCI, BbvI, BccI, BceAI, BcgI, BciVI, BclI, BcnI, BcuI, BfaI, BfiI, BfmI BfrBI, BfuAI, BfuCI, BfuI, BglI, BglII, BlpI, Bme1390I, Bme1580I, BmgBI, BmrI, BmtI, BoxI, BpiI, BplI, BpmI, Bpu10I, Bpu1102I, BpuEI, BsaAI, BsaBI, BsaHI, BsaI, BsaJI, BsaMI, BsaWI, BsaXI, BseDI, BseGI, BseJI, BseLI, BseMI, BseMII, BseNI, BseRI, BseSI, BseXI, BseYI, BsgI, Bsh1236I, Bsh1285I, BshNI, BshTI, BsiEI, BsiHKAI, BsiWI, BslI, BsmAI, BsmBI, BsmFI, BsmI, BsoBI, Bsp19I, Bsp120I, Bsp1286I, Bsp1407I, Bsp143I, Bsp143II, Bsp68I, BspCNI, BspDI, BspEI, BspHI, BspLI, BspMI, BspPI, BspQI, BspTI, BsrBI, BsrDI, BsrFI, BsrGI, BsrI, BsrSI, BssHII, BssKI, BssSI, Bst1107I, Bst98I, BstAPI, BstBI, BstEII, BstF5I, BstNI, BstOI, BstUI, BstXI, BstYI, BstZI, BstZ17I, Bsu15I, Bsu36I, BsuRI, BtgI, BtgZI, BtsCI, BtsI, BveI, Cac8I, CaiI, CfoI, Cfr10I, Cfr13I, Cfr42I, Cfr9I, CfrI, ClaI, CpoI, Csp45I, Csp6I, CspI, CspCI, CviaII, CviKI-1, CviQI, DdeI, DpnI, DpnII, DraI, DraIII, DrdI, EaeI, EagI, Eam1104I, Eam1105I, EarI, EciI, Ecl136II, EclHKI, Eco105I, Eco130I, Eco147I, Eco24I, Eco31I, Eco32I, Eco47I, Eco47III, Eco52I, Eco57I, Eco57MI, Eco72I, Eco81I, Eco88I, Eco91I, EcoICRI, EcoNI, EcoO109I, EcoP15I, EcoRI, EcoRV, EheI, Esp3I, FatI, FauI, Fnu4HI, FokI, FseI, FspI, FspAI, GsuI, HaeII, HaeIII, HgaI, HhaI, Hin1I, Hin4I, Hin6I, HincII, HindIII, HinfI, HinP1I, HpaI, HpaII, HphI, Hpy166II, Hpy188I, Hpy188III, Hpy8I, Hpy99I, HpyAV, HpyCH4III, HpyCH4IV, HpyCH4V, HpyF10VI, Hsp92I, Hsp92II, I-PpoI, I-CreI, KasI, Kpn2I, KpnI, KspAI, LweI, MbiI, MboI, MboII, MfeI, MisI, MluI, MlyI, MmeI, MnlI, Mph1103I, MscI, MseI, MslI, MspA1I, MspI, MssI, MunI, Mva1269I, MvaI, MwoI, NaeI, NarI, NciI, NcoI, NdeI, NdeII, NgoMIV, NheI, NheI-HF, NlaIII, NlaIV, NmeAIII, NmuCI, NotI, NruI, NsbI, NsiI, NspI, OliI, PacI, PaeI, PaeR7I, PagI, PauI, PciI, PdiI, PdmI, Pfl23II, PflFI, PflMI, PfoI, PhoI, PleI, PmeI, PmlI, PpiI, PpuMI, PshAI, PsiI, Psp1406I, Psp5II, PspGI, PspOMI, PspXI, PstI, PsuI, PsyI, PvuI, PvuII, PvuII-HF, RsaI, RsrII, SacI, SacII, SalI, SalI-HF, SapI, SatI, Sau3AI, Sau96I, SbfI, ScaI, ScaI-HF, SchI, ScrFI, SdaI, SduI, SexAI, SfaNI, SfcI, SfiI, SfoI, SgfI, SgrAI, SinI, SmaI, SmiI, SmlI, SmuI, SnaBI, SpeI, SphI, SphI-HF, SspI, StuI, StyD4I, StyI, SwaI, TaaI, TaiI, TaqαI, TaqI, TasI, TatI, TauI, TfiI, TliI, Tru1I, Tru91, TseI, Tsp45I, Tsp509I, TspMI, TspRI, Tth111I, TurboNaeI, TurboNarI, Van91I, VspI, XagI, XapI, XbaI, XceI, XcmI, XhoI, XhoII, XmaI, XmaJI, XmiI, XmnI, and ZraI. Aspects also include homing endonucleases such as: I-SceI, I-CeuI, and PI-PspI. The corresponding cleavage sites for these enzymes are known in the art.

In some embodiments, the present disclosure teaches the use of rare restriction enzymes, recognizing sites greater than or equal to eight nucleotides in length (≥8 restriction enzymes). In some embodiments, the present disclosure teaches use of a single rare restriction site in each cTAG. In other embodiments, the cTAGs of the present disclosure may comprise two or more restriction sites. Table 2 below provides a list of cTAGs according to the present invention, each with their rare restriction enzyme sites bolded.

TABLE 2

Example cTAG sequences, CRISPR landing sites, and rare restriction enzyme sites (bold sequence portions are restriction sites)

| | | | |
|---|---|---|---|
| TagA | ACTGGGTGGAATCCCTTCTGCAGCACCTGGATTACCCTGTTATCCCTAGT | I-SceI | SEQ ID NO: 65 |
| TagB | TAATGAGTAGTCCTCATCTCCCTCAAGCAGGCGCCGGCGGTACTGCCATC | MreI | SEQ ID NO: 66 |
| TagC | CATATAATCTCCCTCAAGCAGGCCCCGCTGGCGCGCGCGAATGTTAGGAA | MauBI | SEQ ID NO: 67 |
| TagD | GCCTATAATGTGAAGAGCTTCACTGAGTAGGGCCCGGGCTGTAAACGGTT | SrfI | SEQ ID NO: 68 |
| TagE | ATTCGCTAGCAGATGTAGTGTTTCCACAGGGGCGATCGCTGATATGGGTC | AsiSI | SEQ ID NO: 69 |
| TagF | ACTACCTAGCTGCATTTTCAGGAGGAAGCGATGGGCGGCCGCACACCTTC | NotI | SEQ ID NO: 70 |
| TagG | TGATAATGGGTGAGTGAGTGTGTGCGTGTGGGGCGCGCCAGATGGGAACA | AscI | SEQ ID NO: 71 |
| TagH | ACTCCAGTCTTTCTAGAAGATGGCAAACAGCTATTATGGGTATTATGGGT | PI-PspI | SEQ ID NO: 72 |
| TagI | TAGTGGACGGGGCCACTAGGGACAGGATTGGCCTGCAGGATTCCCGTCAA | SbfI | SEQ ID NO: 73 |
| TagJ | TGAACTAAGGCGGCTGCACAACCAGTGGAG GCCTAAATGATC | none | SEQ ID NO: 74 |

In some embodiments, suitable recombination sites for use in the present invention include, but are not limited to: attB sites, attP sites, attL sites, attR sites, lox sites, psi sites, tnpI sites, dif sites, cer sites, frt sites, and mutants, variants and derivatives thereof. In certain embodiments of the present invention, the topoisomerase recognition site, if present, is recognized and bound by a type I topoisomerase, which may be a type IB topoisomerase. Suitable types of type IB topoisomerase include, but are not limited to, eukaryotic nuclear type I topoisomerase and poxvirus topoisomerase. In some embodiments, suitable types of poxvirus topoisomerase include, but are not limited to, poxvirus topoisomerase produced by or isolated from a virus such as vaccinia virus, Shope fibroma virus, ORF virus, fowlpox virus, molluscum contagiosum virus and Amsacta morreientomopoxvirus.

In some embodiments, cTAG arrangement of CRISPR and non-CRISPR cloning sites can be ordered according to user preference. In some embodiments, the present disclosure teaches that CRISPR binding sites should be ordered so as to be the furthest away from insert parts. In one illustrative embodiment, a cTAG could be arranged as follows from 5'-3': (Part I)-[R1-A1-C-A2-R2]-(Part II), where R=restriction site, A=recombinase site, and C=CRISPR landing site. In some embodiments, C may include multiple overlapping, or sequential CRISPR and/or restriction landing sites. In some embodiments, the arrangement of cloning sites on a cTAG of the present disclosure will be symmetrical (i.e., provide for a symmetrical order of types of cloning sites).

In other embodiments, arrangement of cloning sites on a cTAG of the present disclosure may be non-symmetrical. For example, in another illustrative embodiment, a cTAG could be arranged as follows from 5'-3': (Part I)-[R1-A1-C1-C2]-(Part II), where R=restriction site, A=recombinase site, and C1-2=CRISPR landing site(s). In yet other embodiments, a cTAG could be arranged as follows from 5'-3': i) (Part I)-[R1-C1-C2]-(Part II), ii) (Part I)-[R1-C1]-(Part II), iii) (Part I)-[C1-C2]-(Part II), or their reverse order, wherein R=restriction site, A=recombinase site, and C1-2=CRISPR landing site(s).

Persons having skill in the art will recognize the advantages and applications of various cTAG arrangements. For example, in single-tag embodiments, the modular construct would allow for insertion with the digestion of a single CRISPR endonuclease, but would not (without more, for example further digestion of additional cTAGs) allow for removal or replacement of said insertion, due to the lack of a second flanking cTAG site. In some embodiments, the present disclosure teaches that inserted parts may themselves contain additional cTAGs, to expand the number of possible insert part locations within the cMCS.

In other embodiments, the present disclosure teaches methods of removing one or more insert parts from the modular CRISPR constructs. In some embodiments, two or more of the cTAGs of a modular CRISPR construct comprise restriction enzyme binding sites capable of creating compatible ends. In some embodiments, the restriction enzyme sites are identical. In other embodiments, the restriction enzyme sites are distinct, but the resulting digestion of said sites produces compatible ends for hybridization and ligation. In some embodiments, the restriction sites for deletion of portions of a modular CRISPR construct are placed on other ends of two or more cTAGS, such that the resulting ligated construct will still maintain the same ratio of insert parts to cTAGS.

In some embodiments, the present disclosure teaches that the restriction enzyme sites used for deletions within the modular CRISPR constructs of the present disclosure can be any restriction enzyme that results in compatible ends. In other embodiments, the present disclosure teaches that the restriction enzyme sites used for deletions within the modular CRISPR constructs of the present disclosure can be any rare 8≥base restriction enzyme that result in compatible ends. In selected embodiments, the present disclosure teaches that the restriction enzyme sites used for deletions within the modular CRISPR constructs of the present disclosure can be I-SceI and PI-PspI.

In some embodiments, the present disclosure teaches modular CRISPR constructs with two cTAGs flanking each insert part, so as to create a cTAG pair. In some embodiments, the aforementioned cTAG pairs allow for the selective cutting/replacement of insert parts. For example, as illustrated in FIG. 2B, digestion of the modular CRISPR plasmid with endonucleases targeting cTAGs A and B would result in the specific removal of insert part 2.

As discussed above, selected embodiments of the present disclosure provide for replacement insert parts that restore cTAG function following endonuclease cleavage. Thus, as illustrated in FIG. 2B, replacement insert parts 2a-2d comprise sequences that will restore cTAG A and B function upon insertion into the modular CRISPR plasmid.

In some embodiments, the present disclosure teaches that cTAGs can also control insert part directionality. Sequence homology between cTAG ends in insert parts and cleaved cTAGs in the modular CRISPR construct will determine insertion directionality for Cas9 cleaved sequences, either through homologous recombination or hybridization (e.g., in Gibson approaches). Insertion directionality in Cpf1 sequences may also be controlled via Watson crick hybridization of Cpf1 sticky ends on either cTAG.

In some embodiments, the present disclosure also provides for alternative cTAG arrangements. For example, in some embodiments, the modular CRISPR constructs of the present disclosure may be designed such as to provide functionality for the use of nested cTAGs.

In some embodiments, the present disclosure teaches component-based CRISPR assemblies based on shared overlapping "tag" regions that enable multicomponent assembly in vitro and in vivo. In some embodiments, the tags of the present disclosure comprise CRISPR landing sites to facilitate future cloning or in vitro DNA assembly from DNA constructs. If DNA constructs are integrated into the genome of a host organism, preselected Cas9 or Cpf1 landing sites may facilitate facile genetic alterations. In a single suite of experiments, the assembly strategy enables construction of DNA plasmids that can be used in multiple organisms, containing multiple numbers and types of DNA components.

In some embodiments, this assembly strategy can be used to assemble and quickly reassemble plasmids encoding any desired set of DNA components, including metabolic pathways. In other embodiments, designing cTAGs into integrating plasmids can also be used to swap DNA components directly in and out of the genome of host organisms, circumventing the need to clone future plasmids.

cTAG Sequence Design Algorithm

In some embodiments, the present disclosure teaches algorithms designed to facilitate CRISPR landing sites within cTAGs. In some embodiments, the CRISPR landing sites are sequences identified from existing sequences. Thus, in some embodiments, the present disclosure teaches use of software programs is designed to identify candidate CRISPR target sequences on both strands of an input DNA sequence based on desired guide sequence length and a CRISPR motif sequence (PAM, protospacer adjacent motif) for a specified CRISPR enzyme. For example, target sites for Cpf1 from *Francisella novicida* U112, with PAM sequences TTN, may be identified by searching for 5'-TTN-3' both on the input sequence and on the reverse-complement of the input. The target sites for Cpf1 from Lachnospiraceae bacterium and *Acidaminococcus* sp., with PAM sequences TTTN, may be identified by searching for 5'-TTTN-3' both on the input sequence and on the reverse complement of the input. Likewise, target sites for Cas9 of *S. thermophilus* CRISPR1, with PAM sequence NNAGAAW, may be identified by searching for 5'-Nx-NNAGAAW-3' both on the input sequence and on the reverse-complement of the input. The PAM sequence for Cas9 of *S. pyogenes* is 5'-NGG-3'.

Likewise, target sites for Cas9 of *S. thermophilus* CRISPR, with PAM sequence NGGNG, may be identified by searching for 5'-N, -NGGNG-3' both on the input sequence and on the reverse-complement of the input.

In other embodiments, the present disclosure teaches methods of designing CRISPR landing sites from scratch. Persons having skill in the art will readily be able to design CRISPR landing sites in conjunction with the guide RNAs of the present disclosure, wherein the resulting protospacer sequence is combined with the PAM motif appropriate to the desired CRISPR endonuclease, as described above.

In some embodiments, the present disclosure teaches cTAGs comprising a sequence selected from the group consisting of: SEQ ID NO. 65, 66, 67, 68, 69, 70, 71, 72, 73, 74, 78, 79, 80, 81, and combinations thereof.

Since multiple occurrences in the genome of the DNA target site may lead to nonspecific genome editing, after identifying all potential sites, the present disclosure teaches, in some embodiments, filtering out sequences based on the number of times they appear in the relevant reference genome or modular CRISPR construct. For those CRISPR enzymes for which sequence specificity is determined by a 'seed' sequence (such as the first 5 nt of the guide sequence for Cpf1-mediated cleavage) the filtering step may also filter out different sequences with the same seed.

In some embodiments, algorithmic tools can also identify potential off target sites for a particular guide sequence. For example, in some embodiments Cas-Offinder can be used to identify potential off target sites for Cpf1 (see Kim et al., 2016. "Genome-wide analysis reveals specificities of Cpf1 endonucleases in human cells" published online Jun. 6, 2016). Any other publicly available CRISPR design/identification tool may also be used, including for example the Zhang lab's crispr.mit.edu tool (see Hsu, et al. 2013 "DNA targeting specificity of RNA_guided Cas9 nucleases" Nature Biotech 31, 827-832).

In some embodiments, the user may be allowed to choose the length of the seed sequence. The user may also be allowed to specify the number of occurrences of the seed: PAM sequence in a genome for purposes of passing the filter. The default is to screen for unique sequences. Filtration level is altered by changing both the length of the seed sequence and the number of occurrences of the sequence in the genome. The program may, in addition, or alternatively, provide the sequence of a guide sequence complementary to the reported target sequence(s) by providing the reverse complement of the identified target sequence(s).

Modular CRISPR DNA Construct Cloning

In some embodiments, the present disclosure teaches methods for preparing new recombinant nucleic acid molecules using the modular CRISPR DNA constructs of the present disclosure. In some embodiments, the present disclosure teaches methods of DNA part assembly. Descriptions of each method are provided below.

DNA Assembly Methods

In some embodiments, the present disclosure teaches methods for the modular assembly of DNA parts. In some embodiments, the DNA assembly methods of the present disclosure are conducted in vitro. Thus, in some embodiments, the present disclosure teaches the steps of i) forming a mixture comprising at least two insert part DNAs together with at least one CRISPR complex, and ii) allowing said mixture to incubate in conditions for CRISPR digestion of the insert DNAs, iii) followed by hybridizing the compatible sticky ends from the digestion of each of the two insert part DNAs, and iv) ligating said hybridized ends to one another to create the new recombinant nucleic acid. Thus, in some embodiments, the insert part DNAs of the present disclosure are digested together. In other embodiments, the present disclosure teaches methods of digesting each insert part DNA individually, with the same or different CRISPR complexes. In some embodiments, at least one insert part is not digested by a CRISPR complex. In some embodiments, the present disclosure teaches that an exonuclease treatment is conducted prior to the hybridization of step iii) (for dual CRISPR digestions as described in later sections).

In yet other embodiments, the present disclosure teaches Gibson-like joining of insert parts, by exposing the insert part ends to an ssDNA exonuclease, and hybridizing the resulting sticky ends followed by an optional fill with polymerase, and ligation. In some embodiments, one or more insert parts are exposed to a dsDNA exonuclease prior to the ssDNA exonuclease treatment. In some embodiments, the present disclosure teaches Gibson-like joining of insert parts or modular CRISPR vectors that have been digested by one or more CRISPR endonuclease (e.g., dual CRISPR digestions, as described in later sections).

The sections below provide a series of illustrative examples demonstrating the various ways in which the insert parts and modular CRISPR constructs of the present disclosure can be assembled and edited. The list of techniques described below provides an illustrative series of examples highlighting the utility of the sequences of the present disclosure, but is not intended to be limiting. Persons having skill in the art will recognize other techniques that allow for the assembly and editing of insert parts according to the present disclosure.

In some embodiments, the present disclosure describes methods involving Cpf1 and/or Cas9 CRISPR endonucleases. Reference to these specific CRISPR endonucleases is illustrative, and is not intended to be limiting, unless specified in a claim. Persons having skill in the art will immediately recognize the applicability of other existing— or heretofore undiscovered CRISPR endonucleases to the constructs and methods of the present disclosure. References to Cpf1 may be interpreted as encompassing use of any presently known or undiscovered CRISPR endonuclease capable of catalyzing staggered DNA cleavage to produce sticky DNA ends. References to Cas9 may similarly be interpreted as encompassing use of any presently known or undiscovered CRISPR endonuclease capable of catalyzing blunt end cleavage of dsDNA.

In Vitro Cpf1

In some embodiments, the in vitro DNA assemblies of the present disclosure are conducted with Cpf1 CRISPR complexes as described below. First, two or more insert parts are incubated with a Cpf1 CRISPR complex targeting the cTAG that is common between the at least two insert parts. In some embodiments, the insert parts are incubated together in a single mixture. In other embodiments, the insert parts are incubated in different mixtures.

Second, in some embodiments, the digested products are purified to remove active CRISPR nuclease. In some embodiments, the purification involves separation of the active Cpf1 complex from the digested insert parts. In some embodiments, this can be accomplished through a DNA purification, such as a gel or column purification. In other embodiments, the purification can be accomplished by Cpf1 inactivation, such as through heat or chemical inactivation.

Third, the digested insert parts are incubated in conditions appropriate for hybridization of the compatible sticky ends created by the Cpf1 complex. Hybridized ends are then ligated according to any known ligation methods, including those described in earlier portions of this disclosure.

In some embodiments the present disclosure teaches DNA assemblies using a CRISPR and Ligase Cloning method (termed "CLIC") (see U.S. Ser. No. 16/310,895; WO/2018/013990, both of which are hereby incorporated in their entireties).

In the CLIC technique, crRNA targeting polynucleotides are designed to bind in inverse orientation to the inner portion of a DNA insert region slated for deletion (e.g., a Multi Clonal Site "MCS") so as to cleave towards the outside of the removed DNA fragment. Separate crRNA targeting polynucleotides are also designed to target the outer ends of DNA inserts (e.g., a gene of interest "GOI"), so as to remove the DNA binding sites during the reaction. In some embodiments, the crRNA guide sequences can be the same.

Designing the crRNA binding sites in inverse orientation, ensures that the sites are removed in the cleavage process, allowing two DNA fragments flanked by compatible sequence overhangs to be ligated seamlessly in the same reaction.

In Vitro Cas9

In other embodiments, the in vitro DNA assemblies of the present disclosure are conducted with Cas9 CRISPR complexes as described below. First, two or more insert parts are incubated with a Cas9 CRISPR complex targeting the cTAG that is common between the at least two insert parts. In some embodiments, the insert parts are incubated together in a single mixture. In other embodiments, the insert parts are incubated in different mixtures.

Second, in some embodiments, the digested products are purified to remove active CRISPR nuclease. In some embodiments, the purification involves separation of the active Cas9 complex from the digested insert parts. In some embodiments, this can be accomplished through a DNA purification, such as a gel or column purification. In other embodiments, the purification can be accomplished by Cas9 inactivation, such as through heat or chemical inactivation.

In some embodiments, the third step for Cas9 digested products is to incubate the insert parts in conditions appropriate for blunt end-ligation.

Dual CRISPR Assemblies

In other embodiments, the present disclosure also teaches Gibson-assembly type methods for assembling the pieces of CRISPR-digested insert parts with at least one shared cTAG sequence (e.g., assembly of compatible cTAGs digested at different CRISPR landing sites). Thus, in some embodiments, the present disclosure teaches dual CRISPR digestion assemblies as described below.

First, two or more insert parts are incubated with two CRISPR complexes targeting two different CRISPR landing sites flanking each part within the aforementioned cTAGs that are common between the at least two insert parts.

In some embodiments, the two different CRISPR landing sites are digested together. In other embodiments, one insert part DNA is digested with one CRISPR complex targeting one CRISPR landing site, and the other insert part DNA is digested with a different CRISPR complex targeting the second CRISPR landing target site in separate vessels. In each case, the result of these digestions will be that the shared cTAG in each of the two insert DNA cTAGs will comprise at least 1, 2, 3, 4, 5, 6, 7, 8, 9, 10, 11, 12, 13, 14, 15, 16, 17, 18, 19, or 20 bp of sequence overlap with each other.

For example, in an illustrative embodiment, the shared cTAG between two insert DNA parts would be arranged as follows from 5'-3': (Part I)-[R1-C1-C2]-(Part II), where R=restriction site, C1=a first CRISPR landing site and C2=a second CRISPR landing site. In this illustrative embodiment, the first insert DNA part with a 3' shared cTAG would be digested with a CRISPR complex targeting C2 and the second insert DNA part with a 5' shared cTAG would be digested with a CRISPR complex targeting C1. This would result in two DNA insert parts with overlapping sequence spanning C1-C2.

Second, in some embodiments, the digested products are purified to remove active CRISPR nuclease. In some embodiments, the purification involves separation of the active CRISPR complex from the digested insert parts. In some embodiments, this can be accomplished through a DNA purification, such as a gel or column purification. In other embodiments, the purification can be accomplished by CRISPR inactivation, such as through heat or chemical inactivation.

Third, in some embodiments, the CRISPR-digested insert parts are incubated with a ssDNA exonuclease to create overlapping sticky ends between the two insert DNA parts.

Fourth, the digested insert parts are incubated in conditions appropriate for hybridization of the compatible sticky ends created by the CRISPR complex/exonuclease digestions. Hybridized ends are then ligated according to any known ligation methods, including those described in earlier portions of this disclosure. In some embodiments, the hybridized parts are incubated with a polymerase to fill in any missing sequence gaps prior to ligation.

Bridging Assemblies

In other embodiments, the present disclosure teaches Gibson-assembly of Cas9 digested parts, through the addition of a third DNA sequence comprising a bridging sequence that overlaps with the digested cTAG sequences of the insert parts.

In this illustrative example, both insert parts are digested with the same Cas9 CRISPR complex targeting the same CRISPR landing site. In this embodiment, the resulting digested cTAGs would have no sequence overlap. Thus, in some embodiments, the third step is for Cas9 digested insert parts to be further digested with an ssDNA exonuclease to create either 3' or 5' overhang. The exonuclease digested insert parts are then incubated in conditions appropriate for hybridization of the compatible sticky ends created by the combination of the CRISPR complex and exonuclease digestions with the bridging sequence. Hybridized ends are then ligated according to any known ligation methods, including those described in earlier portions of this disclosure. In some embodiments, the exonuclease digestion of the present disclosure is conducted before the second step.

In Vitro HDR

In other embodiments, the present disclosure teaches in vitro methods of assembling the ends of insert part DNAs digested by a Cas9 or Cpf1 endonuclease with an HDR complex, thereby triggering recombination of said digested insert parts.

In Vivo Homologous Recombination

In some embodiments, the in vivo DNA assemblies of the present disclosure are conducted with Cpf1 or Cas9 CRISPR complexes as described below. In one embodiment, two or more insert parts with at least one shared cTAG are introduced into a host cell. In some embodiments, the presence of DNA insert parts with homologous shared cTAG sequences will be sufficient to trigger homologous recombination assembly (e.g., yeast homologous recombination).

For example, in some embodiments, at least one shared cTAG sequence between the two insert DNA parts could be assembled to produce a linear construct. In this illustrative embodiment, the two remaining outer cTAGs could also be designed to recombine with cTAGs of another vector within the cell (e.g., insertion into an existing plasmid, or a chromosome). In other embodiments, the two parts could be further assembled into a circular construct through the recombination of a second shared cTAG between the two insert DNA parts. The assembled construct can be either used in the organism that was used for the assembly, or can, in some embodiments, be purified and transformed into a second organism (e.g., assembly in yeast, and subsequent transformation into bacteria).

In other embodiments, one or more insert parts with a shared cTAG can be digested prior to introduction into the host cell. Thus, in some embodiments, the present disclosure teaches CRISPR digestions to release insert parts from larger vectors prior to in vivo assembly of the released parts. In some embodiments, the digestion is carried out with Cas9. In other embodiments, the digestion is carried out with Cpf1. In other embodiments, the digestion is carried out with restriction endonucleases. In some embodiments, the CRISPR digestions of insert parts are conducted in vitro. In some embodiments, the digested products are purified to remove active CRISPR endonuclease prior to transformation of the insert parts into the assembly host cell.

In some embodiments, the purification step can be accomplished through a DNA purification, such as a gel or column purification. In other embodiments, the purification can be accomplished by CRISPR inactivation, such as through heat or chemical inactivation.

In Vivo Ligation

In some embodiments, the present disclosure teaches methods of protecting insert parts from re-cleavage by the CRISPR endonuclease. In some embodiments, the insert parts of the present disclosure may be protected from endonuclease cleavage via chemical modification of the DNA sequence. For example, in some embodiments, the present disclosure teaches phosphorothioate oligonucleotides.

In some embodiments, the methods of the present disclosure are especially useful for multi-part DNA assemblies.

FIG. 2A of the specification provides an illustrative example of a multi-part DNA assembly, according to the methods of the present disclosure. In this example, a series of eight DNA parts (parts 1-8), each with two cTAGs (tags A-H) are combined in vitro and are then able to self-assemble (either via homologous recombination in vivo, or via ligation, as described above).

DNA Editing Methods

In some embodiments, the present disclosure teaches methods for the editing of modular CRISPR DNA constructs. In some embodiments, the DNA editing methods of the present disclosure apply the same principles of the DNA assembly methods described above, but do so for the purposes of editing one or more pre-existing modular CRISPR DNA constructs.

In some embodiments, the DNA editing methods of the present disclosure are conducted in vitro. Thus, in some embodiments, the present disclosure teaches the steps of i) forming a mixture comprising a modular CRISPR DNA construct, and at least one insert DNA part, together with at least one CRISPR complex, and ii) allowing said mixture to incubate in conditions for CRISPR digestion of the cTAGS of the insert DNA, and its corresponding modular CRISPR DNA construct cTAGs, followed by iii) hybridizing the compatible sticky ends (if Cpf1) produced by the digestion of each of the aforementioned cTAGs, and iv) ligating said hybridized ends (or blunt ends, if Cas9 is used) to one another to create the new recombinant nucleic acid. In some embodiments, an exonuclease treatment is conducted prior to the hybridization of step iii) (for dual CRISPR digestions as described in later sections). In some embodiments, the digestions of the present disclosure are conducted separately for the insert part DNA and modular CRISPR DNA construct. In some embodiments, only the modular CRISPR DNA construct is digested with a CRISPR complex.

In Vitro Cpf1

In some embodiments, the in vitro DNA editing methods of the present disclosure are conducted with Cpf1 CRISPR complexes as described below. First, a modular CRISPR DNA construct, and at least one insert DNA part are incubated with a Cpf1 CRISPR complex targeting the cTAGs of the insert parts, and their corresponding tags within the modular CRISPR DNA construct. In some embodiments, the digestion of the modular CRISPR DNA and the insert part DNA is conducted in separate reactions.

Second, in some embodiments, the digested products are purified to remove active CRISPR nuclease. In some embodiments, the purification involves separation of the active Cpf1 complex from the digested nucleotides. In some embodiments, this can be accomplished through a DNA purification, such as a gel or column purification. In other embodiments, the purification can be accomplished by Cpf1 inactivation, such as through heat or chemical inactivation.

Third, the digested modular CRISPR DNA construct and insert parts are incubated in conditions appropriate for hybridization of the compatible sticky ends created by the Cpf1 complex. Hybridized ends are then ligated according to any known ligation methods, including those described in earlier portions of this disclosure.

In Vitro Cas9

In other embodiments, the in vitro DNA editing methods of the present disclosure are conducted with Cas9 CRISPR complexes as described below. First, a modular CRISPR DNA construct, and at least one insert DNA part are incubated with a Cas9 CRISPR complex targeting the cTAGs of the insert parts, and their corresponding tags within the modular CRISPR DNA construct. In some embodiments, the digestion of the modular CRISPR DNA and the insert part DNA are conducted in separate reactions.

Second, in some embodiments, the digested products are purified to remove active CRISPR nuclease. In some embodiments, the purification involves separation of the active Cas9 complex from the digested nucleotides. In some embodiments, this can be accomplished through a DNA purification, such as a gel or column purification. In other embodiments, the purification can be accomplished by Cas9 inactivation, such as through heat or chemical inactivation.

In some embodiments, the third step for Cas9 digested products is to incubate the insert parts in conditions appropriate for blunt end-ligation.

Gibson Editing

In other embodiments, the present disclosure also teaches Gibson-assembly type methods for editing the sequences of CRISPR-digested constructs and/or undigested insert parts containing intact overlapping cTAG sequence. Thus, in some embodiments, the third step is for Cas9 digested modular CRISPR DNA construct and insert part(s) to be further digested with an ssDNA exonuclease to create either a 3' or 5' overhang. In some embodiments, the present disclosure teaches dsDNA exonuclease digestion to shorten the non-CRISPR digested insert parts prior to the ssDNA digestion.

The exonuclease digested DNA sections are then incubated under conditions appropriate for hybridization of the compatible sticky ends created by the combination of the CRISPR complex and exonuclease digestions. Hybridized ends are then ligated according to any known ligation methods, including those described in earlier portions of this disclosure. In some embodiments, the hybridized DNA is incubated with a polymerase to fill in missing DNA sections prior to ligation. In some embodiments, the exonuclease digestion of the present disclosure is conducted before the CRISPR inactivation step.

In some embodiments, the ligation of digested sequences can occur in vitro.

In other embodiments, the present disclosure teaches in vitro methods of assembling the ends of a modular CRISPR DNA construct digested by a Cas9 or Cpf1 endonuclease, and at least one undigested insert with an HDR complex, thereby triggering recombination of said digested modular CRISPR DNA construct, and at least one insert DNA part.

In some embodiments of the DNA editing methods of the present disclosure, the DNA insert parts are comprised within a second modular CRISPR DNA construct. Thus, in some embodiments, the DNA editing methods of the present disclosure comprise the transfer of a DNA insert part from one modular CRISPR DNA construct to another.

Use of Modular CRISPR DNA Constructs to Modulate CRISPR Activity in a Host Cell

In some embodiments, the present disclosure teaches compositions and methods for modulating CRISPR activity in a cell. Thus, in some embodiments, the present disclosure teaches recombinant modular CRISPR DNA constructs, wherein said constructs comprise a nucleic acid for one or more modulator of CRISPR function.

As used herein, the term "modulator of CRISPR function" should be broadly construed to refer to any sequence, than when present in an extra chromosomal vector, or when integrated into the genome of a host cell, results in a modification (e.g., increase or decrease) of CRISPR activity in the host cell. In some embodiments, the present disclosure teaches that the modulator of CRISPR function is selected from the group consisting of: an origin of replication, a selectable marker, an anti-CRISPR protein, a promoter, a terminator, a dCas protein, a dCpf1 protein, a barcode, a Cas9 protein, a Cpf1 protein, a DNA donor, and a protein that facilitates multiplexing.

In specific embodiments, the modulators of CRISPR function are anti-CRISPR proteins (Pawluk et al., "Anti-CRISPR: discovery, mechanisms and function" Nature Reviews: Microbiology Vol 16, January 2018, pp 12-16). CRISPR-Cas adaptive immune systems are widespread among bacteria and archaea. Recent studies however, have shown that CRISPR systems have minimal long-term evolutionary effects on bacterial immunity, suggesting the presence of anti-CRISPR factors that assist phages and other mobile genetic elements in evading CRISPR-Cas immunity.

To date, there have been 21 unique families of anti-CRISPR proteins described against type I and type II CRISPR-Cas systems. Over the past few years, mechanisms of action have been determined for several anti-CRISPR proteins by use of a combination of genetic, biochemical and structural studies. Some anti-CRISPR proteins negative regulate CRISPR enzyme function by interfering with DNA binding. Other anti-CRISPR proteins trigger dimerization of CRISPR enzymes, thus reducing availability for gene editing. Yet other anti-CRISPR proteins block the endonuclease activity of CRISPR enzymes, thus reducing their ability to make double stranded DNA breaks. In some embodiments, the present disclosure teaches use of anti-CRISPR proteins to modulate the activity of host CRISPR activity, either by affecting native CRISPR systems, or by further modifying the effect of exogenously added CRISPR complexes.

In some embodiments, the modulators of CRISPR function are used to "fine tune" CRISPR activity in a host cell. In other embodiments, the modulators of CRISPR function are used to reduce CRISPR activity in a host cell. In other embodiments, the modulators of CRISPR function are used to increase CRISPR activity in a host cell.

In one illustrative example, the present disclosure teaches the use of anti-CRISPR enzymes for improving the transformation rates of host cells. In some species, CRISPR represents a barrier to transformation. The present disclosure teaches that eliminating CRISPR-based innate immunity through the use of anti-CRISPR proteins can make some microbial species amenable to genetic manipulation. A recent report described various anti-CRISPR proteins derived from phage (Bondy-Denomy et al, 2013 Nature 493:429-432). Using anti-CRISPR proteins to overcome barriers to transformation has a number of advantages: First, the presence of a CRISPR system in the host organism can be easily determined by genomic DNA sequence analysis. Second, co-expression of anti-CRISPR requires no a priori manipulation of the host genome. Third, inducible expression of anti-CRISPR proteins allows for negative selection of plasmids (i.e. plasmids are destroyed in a CRISPR-dependent fashion when anti-CRISPR protein expression is shut off).

In one embodiment, a plasmid encoding one or more anti-CRISPR proteins along with an antibiotic resistance gene and gene(s) of interest are transformed into a new host and transformants are selected based on antibiotic resistance. The presence of antibiotic resistant clones and the loss of antibiotic resistance when anti-CRISPR gene expression is turned off are phenotypes that indicate the barrier to transformation has been effectively eliminated. In a second embodiment, anti-CRISPR protein is co-transformed with said plasmid in order to ensure the plasmid is not restricted by an active CRISPR system before gene expression is established. A non-limiting list of anti-CRISPR proteins compatible with the compositions and methods of the present disclosure is provided in Table 3.

TABLE 3

Non-limiting list of anti-CRISPR proteins of the present disclosure

| Anti-CRISPR protein Family | Characterized member | CRISPR system inhibited | Number of amino acids | Reference disclosing same |
|---|---|---|---|---|
| AcrE1 | JBD5-34 (*Pseudomonos oeruginoso*) | I-E | 100 | Maxwell, K. L. & Davidson, A. R. A new group of phage anti-CRISPR genes inhibits the type I-E CRISPR-Cas system of *Pseudomonas aeruginosa*. mBio 5, e00896 (2014). |

TABLE 3-continued

Non-limiting list of anti-CRISPR proteins of the present disclosure

| Anti-CRISPR protein Family | Characterized member | CRISPR system inhibited | Number of amino acids | Reference disclosing same |
|---|---|---|---|---|
| AcrE2 | JBD88a-3 2 (*P. aeruginosa*) | I-E | 84 | Maxwell, K. L. & Davidson, A. R. A new group of phage anti-CRISPR genes inhibits the type I-E CRISPR-Cas system of *Pseudomonas aeruginosa*. mBio 5, e00896 (2014). |
| AcrE3 | DMS3-30 (*P. aeruginosa*) | I-E | 68 | Maxwell, K. L. & Davidson, A. R. A new group of phage anti-CRISPR genes inhibits the type I-E CRISPR-Cas system of *Pseudomonas aeruginosa*. mBio 5, e00896 (2014). |
| AcrE4 | D3112-31 (*P. aeruginosa*) | I-E | 52 | Maxwell, K. L. & Davidson, A. R. A new group of phage anti-CRISPR genes inhibits the type I-E CRISPR-Cas system of *Pseudomonas aeruginosa*. mBio 5, e00896 (2014). |
| AcrF1 | JBD30-35 (*P. aeruginosa*) | I-F | 78 | Bondy-Denomy, J., Pawluk, A., Maxwell, K. L. & Davidson, A. R. Bacteriophage genes that inactivate the CRISPR/Cas bacterial immune system. Nature 493, 429-432 (2013). |
| AcrF2 | D3112-30 (*P. aeruginosa*) | I-F | 90 | Bondy-Denomy, J., Pawluk, A., Maxwell, K. L. & Davidson, A. R. Bacteriophage genes that inactivate the CRISPR/Cas bacterial immune system. Nature 493, 429-432 (2013). |
| AcrF3 | JBD5-35 (*P. aeruginosa*) | I-F | 139 | Bondy-Denomy, J., Pawluk, A., Maxwell, K. L. & Davidson, A. R. Bacteriophage genes that inactivate the CRISPR/Cas bacterial immune system. Nature 493, 429-432 (2013). |
| AcrF4 | JBD26-3 7 (*P. aeruginosa*) | I-F | 100 | Bondy-Denomy, J., Pawluk, A., Maxwell, K. L. & Davidson, A. R. Bacteriophage genes that inactivate the CRISPR/Cas bacterial immune system. Nature 493, 429-432 (2013). |
| AcrF5 | JBD5-36 (*P. aeruginosa*) | I-F | 79 | Bondy-Denomy, J., Pawluk, A., Maxwell, K. L. & Davidson, A. R. Bacteriophage genes that inactivate the CRISPR/Cas bacterial immune system. Nature 493, 429-432 (2013). |
| AcrF6 | AcrF6$_{Poe}$ (*P. aeruginosa*) | I-E and I-F | 100 | Pawluk, A. et al. Inactivation of CRISPR-Cas systems by anti-CRISPR proteins in diverse bacterial species. Nat. Microbiol. 1, 16085 (2016). |
| AcrF7 | AcrF7$_{Poe}$ (*P. aeruginosa*) | I-F | 67 | Pawluk, A. et al. Inactivation of CRISPR-Cas systems by anti-CRISPR proteins in diverse |

TABLE 3-continued

Non-limiting list of anti-CRISPR proteins of the present disclosure

| Anti-CRISPR protein Family | Characterized member | CRISPR system inhibited | Number of amino acids | Reference disclosing same |
|---|---|---|---|---|
| AcrF8 | Acrf8$_{ZF40}$ (Pectobacterium phage Zf40) | I-F | 92 | bacterial species. Nat. Microbiol. 1, 16085 (2016). Pawluk, A. et al. Inactivation of CRISPR-Cas systems by anti-CRISPR proteins in diverse bacterial species. Nat. Microbiol. 1, 16085 (2016). |
| AcrF9 | AcrF9$_{Vpo}$ (Vibrio parahaemolyticus) | I-F | 68 | Pawluk, A. et al. Inactivation of CRISPR-Cas systems by anti-CRISPR proteins in diverse bacterial species. Nat. Microbiol. 1, 16085 (2016). |
| AcrF10 | AcrF10$_{Sxf}$ (Shewanella xiamenensis) | I-F | 97 | Pawluk, A. et al. Inactivation of CRISPR-Cas systems by anti-CRISPR proteins in diverse bacterial species. Nat. Microbiol. 1, 16085 (2016). |
| AcrIIA1 | AcrIIA1$_{Lmo}$ (Listeria monocytogenes) | II-A | 149 | Rauch, B. J. et al. Inhibition of CRISPR-Cas9 with bacteriophage proteins. Cell 168, 150-158.e10 (2017). |
| AcrIIA2 | AcrIIA2$_{Lmo}$ (L monocytogenes) | II-A | 123 | Rauch, B. J. et al. Inhibition of CRISPR-Cas9 with bacteriophage proteins. Cell 168, 150-158.e10 (2017). |
| AcrII3 | AcrIIA3$_{Lmo}$ (L monocytogenes) | II-A | 125 | Rauch, B. J. et al. Inhibition of CRISPR-Cas9 with bacteriophage proteins. Cell 168, 150-158.e10 (2017). |
| AcrIIA4 | AcrIIA4$_{Lmo}$ (L monocytogenes) | II-A | 87 | Rauch, B. J. et al. Inhibition of CRISPR-Cas9 with bacteriophage proteins. Cell 168, 150-158.e10 (2017). |
| AcrIIC1 | AcrIIC1$_{Nme}$ (Neisserio meningitidis) | II-C | 85 | Pawluk, A. et al. Naturally occurring off-switches for CRISPR-Cas9. Cell 167, 1829-1838.e9 (2016). |
| AcrIIC2 | AcrIIC2$_{Nme}$ (N. meningitidis) | II-C | 123 | Pawluk, A. et al. Naturally occurring off-switches for CRISPR-Cas9. Cell 167, 1829-1838.e9 (2016). |
| AcrIIC3 | AcrIIC3$_{Nme}$ (N. meningiridis) | II-C | 116 | Pawluk, A. et al. Naturally occurring off-switches for CRISPR-Cas9. Cell 167, 1829-1838.e9 (2016). |

Use of Modular CRISPR DNA Constructs in CRISPRi and CRISPRa Applications

Introduction/Background

Metabolic engineering relies heavily on the alteration of key genes involved, both directly and indirectly, in the metabolism, regulation, and catabolism of molecules. For example, it is often useful to decrease the expression of genes involved in siphoning cofactors or metabolic precursors used in competing metabolic pathways. However, the complexity of the metabolome makes it difficult to predict a priori, both the correct genes required for downregulation and the optimal amount of downregulation need to increase yield while limiting cellular toxicity. The epistatic, or non-additive, nature or multiple genetic changes on metabolite production further complicates the prediction of the sets of changes that may be beneficial.

Thus, there is a strong need for technologies and methodologies that enable rapid, high-throughput sampling of regulation networks. There are many strategies that enable the alteration of expression. Altering the copy number of a gene, changing the preferred codon usage of a gene, changing the strength of the promoter driving a gene, altering the ribosomal binding site of a mRNA, and regulating the mRNA transcript have all been employed to effect changes in gene expression. However, each of these changes relies on making a genetic alteration. Depending on the organism used, genome editing is a time consuming, laborious, and often inefficient process. This both limits the scope of changes that can be tested, and in many organisms, prevents multiplexing multiple genomic changes at the same time.

As an alternative to genetic alterations, many researchers have used catalytically inactivated Cas9 (dCas9) to repress transcription in prokaryotic organisms. In prokaryotes, such as *Corynebacterium glutamicum* a dCas9 directed to a promoter or open reading frame (ORF) of a gene can block transcriptional initiation or elongation. Recent publications have also suggested the ability to upregulate genes by fusing transcriptional activation subunits to catalytically inactivated dCas9 genes. Libraries of guide RNAs, targeting different genes for downregulation have been used to screen or select for beneficial changes. Finally, activation of prokaryotic genes has been demonstrated in low throughput in *E. coli*.

However, there is a need to integrate these technologies into a successful and high throughput metabolic engineering campaign. Further, there is a need to combine and apply these disparate strategies into noncanonical organisms such as *Corynebacterium glutamicum*. There is an unmet need for applying large sets of dCas9-directed guide RNA libraries towards metabolic engineering campaigns.

The disclosure describes using Cas9 or dCas9 as a screening tool that will vastly increase the number of transcriptional perturbations that can be tested, while reducing the number of laborious genetic alterations that need to be made. The present disclosure addresses these concerns by leveraging the power and flexibility of the presently disclosed modular CRISPR DNA constructs for CRISPRi/CRISPRa applications. These approaches may be used alone, or, in certain embodiments, can be combined with CRISPR approaches for genome modification to both regulate expression from host genomic sequences and modify the genomic sequence as well. For example, the constructs of this disclosure can include both active and inactive CRISPR proteins encoding DNA, or multiple constructs can be produced where the different constructs contain different CRISPR (e.g., inactive and active) CRISPR forms.

Technological Overview

In some embodiments, the present disclosure teaches methods of modulating the expression of host cell genes via CRISPRi (CRISPR interference) and CRISPRa (CRISPR activation) technologies. In some embodiments, the presently disclosed technologies utilize catalytically inactivated (i.e., nuclease-deactivated) CRISPR endonucleases that have been mutated to no longer generate double DNA stranded breaks, but which are still able to bind to DNA target sites through their corresponding guide RNAs. In some embodiments, the present disclosure refers to these catalytically inactivated CRISPR enzymes as "dead CRISPR", or "dCRISPR" enzymes. The "dead" modifier may also be used in reference to specific CRISPR enzymes, such as dead Cas9 (dCas9), or dead Cpf1 (dCpf1).

Without wishing to be bound by any one theory, the present inventors believe that the dCRISPR enzymes of this technology function by recruiting the catalytically inactivated dCRISPR enzyme to a target DNA sequence via a guide RNA, thereby permitting the dCRISPR enzyme to interact with the host cell's transcriptional machinery for a particular gene.

In some embodiments, The CRISPRi methods of the present disclosure utilize dCRISPR enzymes to occupy target DNA sequences necessary for transcription, thus blocking the transcription of the targeted gene (L. S. Qi et al., "Repurposing CRISPR as an RNA-Guided Platform for Sequence-Specific Control of Gene Expression." Cell. 152, 1173-1183 (2013); see also L. A. Gilbert et al., "CRISPR-Mediated Modular RNA-Guided Regulation of Transcription in Eukaryotes." Cell. 154, 442-451 (2013)). In other embodiments, the CRISPRi methods of the present disclosure utilize dCRISPR enzymes translationally fused, or otherwise tethered to one or more transcriptional repression domains, or alternatively utilize modified guide RNAs capable of recruiting transcriptional repression domains to the target site (e.g., tethered via aptamers, as discussed below).

In some embodiments, the CRISPRa methods of the present disclosure employ dCRISPR enzymes translationally fused or otherwise tethered to different transcriptional activation domains, which can be directed to promoter regions by guide RNAs. (See A. W. Cheng et al., "Multiplexed activation of endogenous genes by CRISPR-on, an RNA-guided transcriptional activator system." Cell Res. 23, 1163-1171 (2013); see also L. A. Gilbert et al., "Genome-Scale CRISPR-Mediated Control of Gene Repression and Activation." Cell. 159, 647-661 (2014)). In other embodiments, the CRISPRa methods of the present disclosure utilize modified guide RNAs that recruit additional transcriptional activation domains to upregulate expression of the target gene (e.g., tethered via aptamers, as discussed below).

In yet other embodiments, the presently disclosed invention also envisions exploiting dCRISPR enzymes and guide RNAs to recruit other regulatory factors to target DNA sites. In addition to recruiting transcriptional repressor or activation domains, as discussed above, the dCRISPR enzymes and guide RNAs of the present disclosure can be modified so as to recruit proteins with activities ranging from DNA methylation, chromatin remodelers, ubiquitination, sumoylation. Thus, in some embodiments, the dCRISPR enzymes and guide RNAs of the present disclosure can be modified to recruit factors with methyltransferase activity, demethylase activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, glycosylase activity, acetyltransferase activity, deacetylase activity, kinase activity, phosphatase activity, ubiquitin ligase activity, deubiquitinating activity, adenylation activity, deadenylation activity, sumoylating activity, desumoylating activity, ribosylation activity, deribosylation activity, myristoylation activity, remodelling activity, protease activity, oxidoreductase activity, transferase activity, hydrolase activity, lyase activity, isomerase activity, synthase activity, synthetase activity, demyristoylation activity, cytidine deaminase activity and any combinations thereof In other embodiments, the dCRISPR enzymes and guide RNAs of the present disclosure can be modified to recruit one or more marker genes/composition, such as fluorescent proteins, gold particles, radioactive isotopes, GUS enzymes, or other known biological or synthetic compositions capable of being detected. This last embodiment would permit researchers to tag and track regions of a host cell's genome. As used herein, the term "cis regulatory factors" refers to any of the biological or synthetic compositions that can be recruited by the dCRISPR or guide RNAs of the present disclosure.

High Throughput CRISPRi and CRISPRa Vectors

In some embodiments, the present disclosure teaches vectors, kits, and methods for high throughput CRISPRi/CRISPRa genetic engineering of host cells. In some embodiments, the present disclosure leverages the power of the modular CRISPR constructs discussed in this application to carry out efficient, genome-wide gene expression modifications (increases or decreases). In some embodiments, the modular CRISPR constructs of the present disclosure are capable of modulating (increasing or decreasing) the expression of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, or more genes at a time.

In some embodiments, the present disclosure teaches modular CRISPR constructs comprising nucleic acids encoding for the CRISPRi or CRISPRa systems of the present disclosure. In some embodiments, the modular CRISPR constructs of the present disclosure comprise i) a first nucleic acid sequence encoding for a dCRISPR enzyme, and ii) a second nucleic acid encoding for a guide RNA capable of recruiting the dCRISPR enzyme to a DNA target site. In other embodiments, the present disclosure teaches that one or more parts of the CRISPRa/CRISPRi system may be excluded from the vector if they are already present in the host, or are otherwise being provided by a separate vector. Thus in some embodiments, a modular CRISPR construct will not encode for a dCRISPR enzyme. In other embodiments, the modular CRISPR construct will not encode for a guide RNA.

Figure 18A:
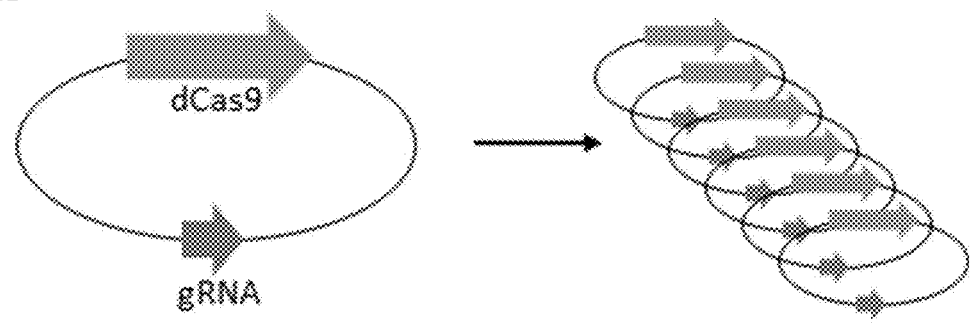
FIG. 18A—depicts CRISPRi/CRISPRa libraries targeting a single promoter.
Figure 18B:
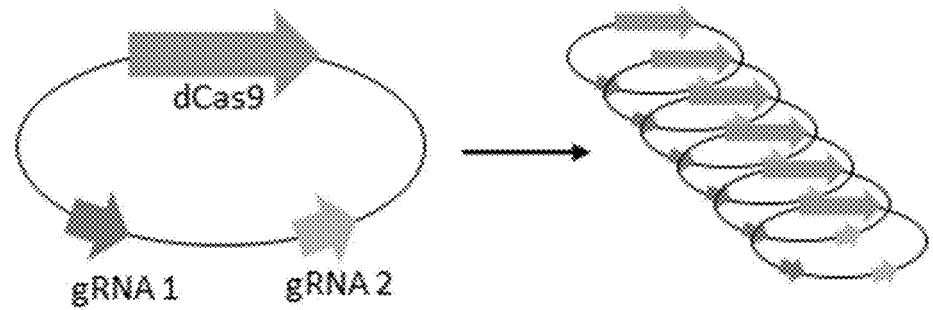
FIG. 18B—depicts CRISPRi/CRISPRa libraries targeting a multiple promoters throughout the genome.

Persons having skill in the art will appreciate that the modular CRISPR constructs of the present disclosure may encode for more than one dCRISPR enzyme and/or more than one guide RNA (see e.g., FIG. 18A-B).

In some embodiments, the nucleic acids encoding for the dCRISPR enzyme and/or the guide RNA are contained in one or more insert parts of a modular CRISPR construct of the present disclosure. Thus, in some embodiments, the modular CRISPR constructs of the present disclosure permit users to quickly and efficiently modify the construct to add or subtract insert parts encoding for different guide RNAs (e.g., guide RNAs targeting different genes, or encoding aptamers capable of recruiting different cis regulatory factors, as discussed above), or encoding different dCRISPR enzymes (e.g., dCas9, or dCpf1, or dCRISPR protein fusions with various cis regulatory factors, as discussed above).

In some embodiments, the present disclosure teaches that an insert part of the modular CRISPR construct comprises only a single coding sequence. That is, in some embodiments, the insert parts of the present disclosure will only encode for a single dCRISPR, or will only encode for a single guide RNA. In other embodiments, the present disclosure teaches insert parts with desirable combinations of genes. For example, in some embodiments, an insert part could be designed so as to encode for multiple guide RNAs, such as guide RNAs targeting two or more genes in a biosynthetic pathway. In other embodiments, a single insert part could be designed to encode for more than one dCRISPR enzyme. In some embodiments, other genes may also be encoded in combination with either guide RNAs or dCRISPR enzymes.

In some embodiments, the insert parts of the present disclosure are designed to encode for selectable markers that can be associated with (i.e., used to demonstrate the presence of) one or more components encoded by the construct, e.g., to identify cells that contain the insert part. Thus, in some embodiments, an insert part can be designed to comprise a selectable marker together with the nucleic acid sequence encoding for a particular dCRISPR enzyme. The present disclosure further envisions the use of selectable markers for the selection of blocks of insert parts, such as for example, a block of guide RNAs targeting a specific biosynthetic pathway, or a block of insert parts coding for one or more cis regulatory factors.

In some embodiments, the insert parts of the present disclosure are designed to be self-contained, comprising all elements necessary for expression of an insert part. That is, in some embodiments, the insert parts of the present disclosure will contain all the necessary promoters and/or terminators necessary for an insert part to be expressed by the host cell machinery (not necessarily counting origin of replication or selectable marker required to maintain a plasmid). In other embodiments, expression of an insert part of the invention will rely on a promoter or terminator sequence located in a different insert part, such as one that is placed immediately upstream of a gene-coding insert part, or one which is placed at the beginning of a nucleic acid coding for a polycistronic mRNA in a single insert part, or spanning more than one insert part.

In some embodiments, the present disclosure teaches the use of inducible promoters to drive the expression of one or more of the insert parts of the modular CRISPR construct. Thus, in some embodiments, the present disclosure teaches the use of inducible promoters to drive the expression of a nucleic acid encoding for a dCRISPR enzyme. In other embodiments, the present disclosure teaches the use of an inducible promoter to drive the expression of a nucleic acid encoding for a guide RNA.

In some embodiments, all the functional parts of the modular cTAG vectors (e.g., all origins, markers, cargo, promoters, terminators, and all elements required for assembly) are comprised within insert DNA parts and can be readily exchanged via the DNA assembly or gene editing methods of the present disclosure. Thus, in specific embodiments, the presently disclosed modular construct permits for the rapid switching and testing of different promoters or terminators that are operably linked to the nucleic acid encoding the dCRISPR enzyme. In other specific embodiments, the presently disclosed modular construct permits for the rapid switching and testing of different promoters or terminators that are operably linked to the nucleic acid encoding the sgRNA or crRNA/tracrRNA or guide RNA or CRISPR enzyme.

Origins of Replication

In some embodiments, the present disclosure teaches the use of origins of replication to maintain (i.e., continue to replicate) a plasmid in one or more species. Persons having skill in the art will be familiar with various available origin of replication sequences. Common features of origins of replications for bacterial, archaeal, eukaryotic, and multicellular organisms is discussed in Leonard and Mechali, "DNA replication Origins" Cold Spring Harb Perspect Biol 2013 October; 5(10). A non-limiting list of common origins of replication are provided below in Table 4.

TABLE 4 list of common vectors and their origin of replication.

| Common Vectors | Copy Number+ | ORI | Control |
| --- | --- | --- | --- |
| pUC | ~500-700 | pMB1 (derivative) | Relaxed |
| pBR322 | ~15-20 | pMB1 | Relaxed |
| pET | ~15-20 | pBR322 | Relaxed |
| pGEX | ~15-20 | pBR322 | Relaxed |
| pColE1 | ~15-20 | ColE1 | Relaxed |
| pR6K | ~15-20 | R6K* | Stringent |

TABLE 4-continued list of common vectors and their origin of replication.

| Common Vectors | Copy Number+ | ORI | Control |
|---|---|---|---|
| pACYC | ~10 | p15A | Relaxed |
| pSC101 | ~5 | pSC101 | Stringent |
| pBluescript | ~300-500 | ColE1 (derivative) and F1** | Relaxed |
| pGEM | ~300-500 | pUC and F1** | Relaxed |

Tethering Cis Regulatory Factors (Transcriptional Modulators)

In some embodiments, the present disclosure teaches the use of a transcriptional modulator. Thus, in some embodiments, the cis regulatory factor is a transcriptional modulator. In some embodiments, transcriptional modulators are chosen based on their ability to further repress, or alternatively, to activate the expression of a gene targeted by the CRISPRi/CRISPRa methods of the present disclosure. In some embodiments, the present disclosure teaches tethering or translationally fusing a transcriptional modulator with the dCRISPR enzyme (i.e., through the use of a fusion construct).

Fusion constructs may generally be prepared using standard techniques. For example, DNA sequences encoding the peptide components may be assembled separately, and ligated into an appropriate construct, such as an insert part. The ligated DNA sequences are operably linked to suitable transcriptional or translational regulatory elements. The 5' or 3' end of the DNA sequence encoding one peptide component is ligated, with or without a peptide linker, to the 3' or 5' end, respectively, of a DNA sequence encoding the second peptide component so that the reading frames of the sequences are in phase. This permits translation into a single fusion protein that retains the biological activity of both component peptides.

In some embodiments, the dCRISPR enzyme and the transcriptional modulator domain are linked via a peptide linker. A peptide linker sequence may be employed to separate the first and the second peptide components by a distance sufficient to ensure that each peptide folds into its secondary and tertiary structures. Such a peptide linker sequence is incorporated into the fusion protein using standard techniques well known in the art. Suitable peptide linker sequences may be chosen based on the following factors: (1) their ability to adopt a flexible extended conformation; (2) their inability to adopt a secondary structure that could interact with functional regions on the first and second peptides; and (3) the lack of hydrophobic or charged residues that might react with the peptide functional regions. In certain embodiments, the peptide linker sequences contain Gly, Asn and Ser residues. Other near neutral amino acids, such as Thr and Ala may also be used in the linker sequence.

In some embodiments, the present disclosure teaches the use of protein-protein interaction domains to tether the transcriptional modulator domains to the dCRISPR. Thus in some embodiments, the sequence of the dCRISPR enzyme is translationally fused to a first protein-protein interaction domain (PP1) capable of dimerizing with a second protein-protein interaction domain (PP2) that is translationally fused to the transcriptional modulator (or other cis regulatory factor). When expressed, each of the dCRISPR-PP1 and the PP2-Transcriptional Modulator will dimerize, thus recruiting the transcriptional modulator to the DNA target site. Persons having skill in the art will be aware of methods of using naturally occurring, or synthetic protein-protein interaction domains to create in-vivo dimers. (See Giescke et al., 2006 "Synthetic protein-protein interaction domains created by shuffling Cys2His2 zinc-fingers." Mol Syst Biol 2: 2006.0011).

In other embodiments, the present disclosure also teaches modified guide RNAs with RNA aptamers capable of recruiting one or more cis regulatory factors. The RNA aptamers of the present disclosure may be operably linked to the 5' or 3' end of a guide RNA, and are designed so as to not affect dCRISPR binding to a DNA target site. Instead, the RNA aptamers provide an additional tether from which to recruit one or more cis regulatory factors, such as transcriptional modulators.

In some embodiments, the present disclosure teaches customized RNA aptamers designed to directly interact with one or more cis regulatory factors. In other embodiments, the present disclosure teaches use of known aptamers targeting specific sequences. Thus, in some embodiments, the present disclosure envisions guide RNAs with validated RNA aptamers, which then bind to their natural targets, which are in turn translationally fused to one or more cis regulatory factor (i.e., guide_RNA-Aptamer-Aptamer_Target-Cis_Regulatory_Factor). In some embodiments, guide RNAs that incorporate RNA aptamers to tether cis regulatory factors are referred to as scaffold RNAs (scRNAs). (Zalatan J G, et al. "Engineering complex synthetic transcriptional programs with CRISPR RNA scaffolds." Cell. 2015; 160:339-350). The scRNAs are designed by extending the guide RNA sequence with orthogonally acting protein-binding RNA aptamers. Each scRNA can encode information both for DNA target recognition and for recruiting a specific repressor or activator protein. By changing the DNA targeting sequence or the RNA aptamers in a modular fashion, multiple dCas9-scRNAs can simultaneously activate or repress multiple genes in the same cell For example, an improvement, termed the synergistic activation mediator (SAM) system, was achieved by adding MS2 aptamers to a guide RNA. The MS2 aptamers were designed to recruit cognate MS2 coat protein (MCP), which were fused to p65AD and heat shock factor 1 (HSF1) (Dominguez et al., 2016 "Beyond editing; repurposing CRISPR-Cas9 for precision genome regulation and interrogation" Nat Rev Mol Cel Biol January 17(1) 5-15). The SAM technology, together with dCas9-VP64, further increased endogenous gene activation compared with dCas9-VP64 alone and was shown to activate 10 genes simultaneously. (Konermann S, et al. "Genome-scale transcriptional activation by an engineered CRISPR-Cas9 complex." Nature. 2014; 517:583-588). Similar results may be achieved through the use of other validated aptamer-scaffold protein combinations, such as PP7 or com. (Zalatan J G, et al. "Engineering complex synthetic transcriptional programs with CRISPR RNA scaffolds." Cell. 2015; 160:339-350).

In some embodiments, the present disclosure also envisions the use of double-sided aptamers capable of tethering a dCRISPR enzyme to one or more cis regulatory factors. The double sided aptamers of the present disclosure function similarly to the aptamers discussed above, but are capable of binding both the dCRISPR protein, and the cis regulatory factor. In one illustrative example, the dCRISPR enzyme would be translationally fused to an MS2 coat protein domain, and the cis regulatory element (a VP16 domain) would be translationally fused to a PP7 domain. The double-sided RNA aptamer would comprise an MS2 binding domain on one end, and a PP7 binding domain on another end. Thus, in some embodiments, the double-sided aptamers of the present disclosure can would be expected to form the following generic structure: dCRISPR-Aptamer_Target-Aptamer_Side1-Aptamer_Side2-Aptamer_Target-Cis_Regulatory_Factor.

A non-limiting list of the transcriptional activation domains compatible with the presently disclosed invention include: fragments of transcription regulatory domains and fragments of domains having transcription regulation function of VP16, VP64, VP160, EBNA2, E1A, Gal4, Oaf1, Leu3, Rtg3, Pho4, Gln3, Gcn4, Gli3, Pip2, Pdr1, Pdr3, Lac9, Teal, p53, NFAT, Sp1 (e.g., Sp1a), AP-2 (e.g., Ap-2a), Sox2, NF-κB, MLL/ALL, E2A, CREB, ATF, FOS/JUN, HSF1, KLF2, NF-1L6, ESX, Oct1, Oct2, SMAD, CTF, HOX, Sox2, Sox4, VPR, RpoZ, or Nanog. In some embodiments the transcriptional activator is VPR (see Kiani S. et al., "Cas9 gRNA engineering for genome editing, activation and repression" Nature Methods 12, 1051-1054 (2015)).

A non-limiting list of the transcriptional repressors compatible with the presently disclosed invention include: Mxi1, Tbx3, KRAB (Kruppel-associated box, Margolin, J. F, et al. "Kruppel-associated boxes are potent transcriptional repression domains." Proc. Natl. Acad. Sci. USA 91, 4509-4513 (1994)), EnR, or SID, SID4X (a tandem repeat of four SID domains linked by short peptide linkers), PIE-1, IAA28-RD among others.

In some embodiments, the transcriptional activation domains of the present disclosure comprise the activation domains of Table 5. Nine-amino-acid transactivation domain (9 aaTAD) defines a novel domain common to a large superfamily of eukaryotic transcription factors represented by Gal4, Oaf1, Leu3, Rtg3, Pho4, Gln3, Gcn4 in yeast and by p53, NFAT, NF-κB and VP16 in mammals. Prediction for 9 aa TADs (for both acidic and hydrophilic transactivation domains) is available online from ExPASy™ and EMBnet™ databases.

TABLE 5

Non-limiting examples of transcriptional activation domains.

| Transcription Factor Source | 9 aa TAD |
|---|---|
| P53 TAD1 | ETFSDLWKL (SEQ ID NO: 114) |
| P53 TAD2 | DDIEQWFTE (SEQ ID NO: 115) |
| MLL | DIMDFVLK (SEQ ID NO: 116) |
| EA2 | DLLDFSMMF (SEQ ID NO: 117) |
| Rtg3 | ETLDFSLVT (SEQ ID NO: 118) |
| CREB | RKILNDLSS (SEQ ID NO: 119) |
| CREBaB6 | EAILAELKK (SEQ ID NO: 120) |
| Gli3 | DDVVQYLNS (SEQ ID NO: 121) |
| Gal4 | DDVYNYLFD (SEQ ID NO: 122) |
| Oaf1 | DLFDYDFLV (SEQ ID NO: 123) |
| Pip2 | DFFDYDLLF (SEQ ID NO: 124) |
| Pdr1 | EDLYSILWS (SEQ ID NO: 125) |
| Pdr3 | TDLYHTLWN (SEQ ID NO: 126) |

Guide RNA Multiplexing Systems

In some embodiments, the present disclosure teaches use of guide RNA multiplexing systems. That is, in some embodiments, the present disclosure teaches methods of expressing more than one guide RNA, for example using multiple promoters or polycistronic transcripts. In some embodiments, the present disclosure teaches the use of Csy4 multiplex systems. When overexpressed, Csy4 efficiently cleaves gRNAs sandwiched between 28 base Csy4 recognition sites. CpfI can also process multiple gRNAs. (See Murata et al. 2018, "Highly multiplexed genome engineering using CRISPR/CAS9 gRNA arrays" PLOS ONE 13(9): e0198714, which is hereby incorporated in its entirety for all purposes). If Csy4 or other multiplexing system is not expressed, the gRNAs cannot be released, adding temporal and/or spatial control to the system In some embodiments, a guide RNA of the present disclosure is flanked by ribonuclease recognition sites. A ribonuclease (abbreviated as RNase) is a nuclease that catalyzes the hydrolysis of RNA. A ribonuclease may be an endoribonuclease or an exoribonuclease. An endoribonuclease cleaves either single-stranded or double-stranded RNA. An exoribonuclease degrades RNA by removing terminal nucleotides from either the 5' end or the 3' end of the RNA. In some embodiments, a guide RNA of the present disclosure is flanked by Csy ribonuclease recognition sites (e.g., Csy4 ribonuclease recognition sites). Csy4 is an endoribonuclease that recognizes a particular RNA sequence, cleaves the RNA, and remains bound to the upstream fragment. In some embodiments, a Csy ribonuclease (e.g., Csy4 ribonuclease) is used to release a guide RNA from an engineered nucleic acid transcript. Thus, in some embodiments, cells are co-transfected with an engineered construct that comprises a nucleotide sequence encoding a guide RNA flanked by Csy4 or other Cas6 ribonuclease recognition sites and an engineered nucleic acid encoding a Csy4 or other Cas6 ribonuclease. Alternatively, or in addition, the cell may stably express, or be modified to stably express, a Csy4 or other Cas6 ribonuclease. In some embodiments, a Csy ribonuclease (e.g., Csy4 ribonuclease) is from Pseudomonas aeruginosa, Staphylococcus epidermidis, Pyrococcus furiosus or Sulfolobus solfataricus. Other ribonucleases and ribonuclease recognitions sites are contemplated herein (see, e.g., Mojica, F. J. M. et al., CRISPR-Cas Systems, RNA-mediated Adaptive Immunity in Bacteria and Archaea, Barrangou, Rodolphe, van der Oost, John (Eds.), 2013, ISBN 978-3-642-34657-6, of which the subject matter relating to ribonucleases/recognition sites is incorporated by reference herein).

In some embodiments, a ribonuclease recognition site (e.g., Csy4 ribonuclease recognition site) is 10 to 50 nucleotides in length. For example, a Csy ribonuclease recognition site may be 10 to 40, 10 to 30, 10 to 20, 20 to 50, 20 to 40 or 20 to 30 nucleotides in length. In some embodiments, a Csy ribonuclease recognition site is 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 nucleotides in length. In some embodiments, a Csy ribonuclease recognition site (e.g., Csy4ribonuclease recognition site) is 28 nucleotides in length. Csy homologs are also contemplated herein (see, e.g., Mojica, F. J. M. et al., CRISPR-Cas Systems, RNA-mediated Adaptive Immunity in Bacteria and Archaea, Barrangou, Rodolphe, van der Oost, John (Eds.), 2013, ISBN 978-3-642-34657-6, of which the subject matter relating to ribonucleases/recognition sites is incorporated by reference herein). Reference is also made to U.S. Pat. No. 9,745,610 and U.S. published application US 2017/022499, each of which is hereby incorporated in its entirety for all purposes.

Expression, Purification, and Delivery

In some embodiments, the present disclosure teaches methods and compositions of vectors, constructs, and nucleic acid sequences encoding CRISPR complexes. In some embodiments, the present disclosure teaches plasmids for transgenic or transient expression of the Cas9 or Cpf1 proteins. In some embodiments, the present disclosure teaches a plasmid encoding chimeric Cas9 or Cpf1 proteins comprising in-frame sequences for protein fusions of one or more of the other polypeptides described herein, including, but not limited to a ligase, a linker, and an NLS.

In some embodiments, the plasmids and vectors of the present disclosure will encode for the Cas9/Cpf1 protein(s) and also encode the crRNA/tracrRNA/sgRNA, and/or donor insert sequences of the present disclosure. In other embodiments, the different components of the engineered complex can be encoded in one or more distinct plasmids.

In some embodiments, the plasmids of the present disclosure can be used across multiple species. Thus, in certain embodiments, a single plasmid can be designed to allow for the introduction of an insert part into multiple species, e.g., multiple bacterial species, e.g., *Corynebacterium glutamicum* and *E. coli*. In other embodiments, the plasmids of the present disclosure are tailored to the organism being transformed. In some embodiments, the sequences of the present disclosure will be codon-optimized to express in the organism whose genes are being edited. Persons having skill in the art will recognize the importance of using promoters providing adequate expression for gene editing. In some embodiments, the plasmids for different species will require different promoters.

In some embodiments, the plasmids and vectors of the present disclosure are selectively expressed in the cells of interest. Thus in some embodiments, the present application teaches the use of ectopic promoters, tissue-specific promoters, developmentally regulated promoters, or inducible promoters. In some embodiments, the present disclosure also teaches the use of terminator sequences.

In some embodiments, the present disclosure also teaches methods of expressing and purifying Cpf1 and/or Cas9 endonuclease protein. In some embodiments, the present disclosure teaches that the proteins of the present disclosure may be produced by any of the commercially available protein production and purification kits or services. For example, in some embodiments, the present disclosure teaches methods of cloning Cas9 and/or Cpf1 into a vector with a polyhistidine (His), glutathione s-transferase (GST), or other purification tag chimeric fusion. In some embodiments, the present disclosure teaches a variety of prokaryotic and eukaryotic organisms, and cell-free protein production systems. For example, in some embodiments, the present disclosure teaches expression of protein expression plasmids in *E. coli* BL21. In some embodiments, the protein production system will be inducible, to reduce the effects of protein toxicity. For example, in some embodiments, the present disclosure teaches methods of using the IPTG or an arabinose induction system.

In some embodiments, the present disclosure also teaches various protein purification schemes, including affinity tags (His-Nickel, GST-Glutathione, etc.). In some embodiments, the present disclosure teaches both native and denaturing conditions for protein purification.

In other embodiments, the present disclosure teaches production of Cas9 and/or Cpf1 via one or more protein production services, including, but not limited to GenScript®, ThermoFisher®, and NovoProtein®.

Transformation

In some embodiments, the present disclosure teaches the use of transformation of the plasmids and vectors disclosed herein. Persons having skill in the art will recognize that the plasmids of the present disclosure can be transformed into cells through any known system as described in other portions of this specification. For example, in some embodiments, the present disclosure teaches transformation by particle bombardment, chemical transformation, *Agrobacterium* transformation, nano-spike transformation, electroporation and virus transformation.

In some embodiments, the vectors of the present disclosure may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., 1986 "Basic Methods in Molecular Biology"). Other methods of transformation include for example, lithium acetate transformation and electroporation (see, e.g., Gietz et al., Nucleic Acids Res. 27:69-74 (1992); Ito et al., J. Bacterol. 153:163-168 (1983); and Becker and Guarente, Methods in Enzymology 194:182-187 (1991)). In some embodiments, transformed host cells are referred to as recombinant host strains.

In some embodiments, the present disclosure teaches high throughput transformation of cells using the 96-well plate robotics platform and liquid handling machines of the present disclosure.

In some embodiments, the present disclosure teaches methods for getting exogenous protein (Cpf1/Cas9 and DNA ligase), RNA (crRNA/tracRNA/GuideRNA), and DNA (insert DNA part or modular CRISPR construct) into the cell. Various methods for achieving this have been described previously including direct transfection of protein/RNA/DNA or DNA transformation followed by intracellular expression of RNA and protein (Dicarlo, J. E. et al. "Genome engineering in *Saccharomyces cerevisiae* using CRISPR-Cas systems." *Nucleic Acids Res* (2013). doi: 10.1093/nar/gkt135; Ren, Z. J., Baumann, R. G. & Black, L. W. "Cloning of linear DNAs in vivo by overexpressed T4 DNA ligase: construction of a T4 phage hoc gene display vector." *Gene* 195, 303-311 (1997); Lin, S., Staahl, B. T., Alla, R. K. & Doudna, J. A. "Enhanced homology-directed human genome engineering by controlled timing of CRISPR/Cas9 delivery." *Elife* 3, e04766 (2014)).

In some embodiments, the present disclosure teaches screening transformed cells with one or more selection markers as described above. In one such embodiment, cells transformed with a vector comprising a kanamycin resistance marker (KanR) are plated on media containing effective amounts of the kanamycin antibiotic. Colony forming units visible on kanamycin-laced media are presumed to have incorporated the vector cassette into their genome. Insertion of the desired sequences can be confirmed via PCR, restriction enzyme analysis, and/or sequencing of the relevant insertion site.

In other embodiments, a portion, or the entire complexes of the present disclosure can be delivered directly to cells. Thus, in some embodiments, the present disclosure teaches the expression and purification of the polypeptides and nucleic acids of the present disclosure. Persons having skill in the art will recognize the many ways to purify protein and nucleic acids. In some embodiments, the polypeptides can be expressed via inducible or constitutive protein production systems such as the bacterial system, yeast system, plant cell system, or animal cell systems. In some embodiments, the present disclosure also teaches the purification of proteins and or polypeptides via affinity tags, or custom antibody purifications. In other embodiments, the present disclosure also teaches methods of chemical synthesis for polynucleotides.

In some embodiments, persons having skill in the art will recognize that viral vectors or plasmids for gene expression can be used to deliver the complexes disclosed herein. Virus-like particles (VLP) can be used to encapsulate ribonucleoprotein complexes, and purified ribonucleoprotein complexes disclosed herein can be purified and delivered to cells via electroporation or injection.

Kits

In some embodiments, the disclosure provides kits containing any one or more of the elements disclosed in the above methods and compositions. In some embodiments, the kit comprises a modular CRISPR DNA construct and instructions for using the kit and any necessary reagents or reactants. In some embodiments, the vector system comprises (a) a modular CRISPR DNA construct (b) a CRISPR complex, including a CRISPR endonuclease protein, and necessary target guide RNA(s) (or sequences encoding said items), and optionally (c) insert DNA parts, as describe supra in this application.

Elements may be provided individually or in combinations, and may be provided in any suitable container, such as a vial, a bottle, or a tube, or host cell, or plasmid. In some embodiments, the kit includes instructions in one or more languages, for example in more than one language.

In some embodiments, a kit comprises one or more reagents for use in a process utilizing one or more of the elements described herein (e.g., purified Cpf1 endonuclease). Reagents may be provided in any suitable container. For example, a kit may provide one or more reaction or storage buffers. Reagents may be provided in a form that is usable in a particular assay, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a crRNA sequence for insertion into a vector so as to operably link the crRNA sequence and a regulatory element.

EXAMPLES

The following examples are given for the purpose of illustrating various embodiments of the disclosure and are not meant to limit the present disclosure in any fashion. Changes therein and other uses which are encompassed within the spirit of the disclosure, as defined by the scope of the claims, will occur to those skilled in the art.

Example 1: One-Pot In Vitro Modular CRISPR Cloning

This example describes the generation of plasmid 13001009086 (SEQ ID NO: 82) by transfer of an insert from one plasmid to another in a one-pot reaction. See, FIG. 4.

Figure 4:
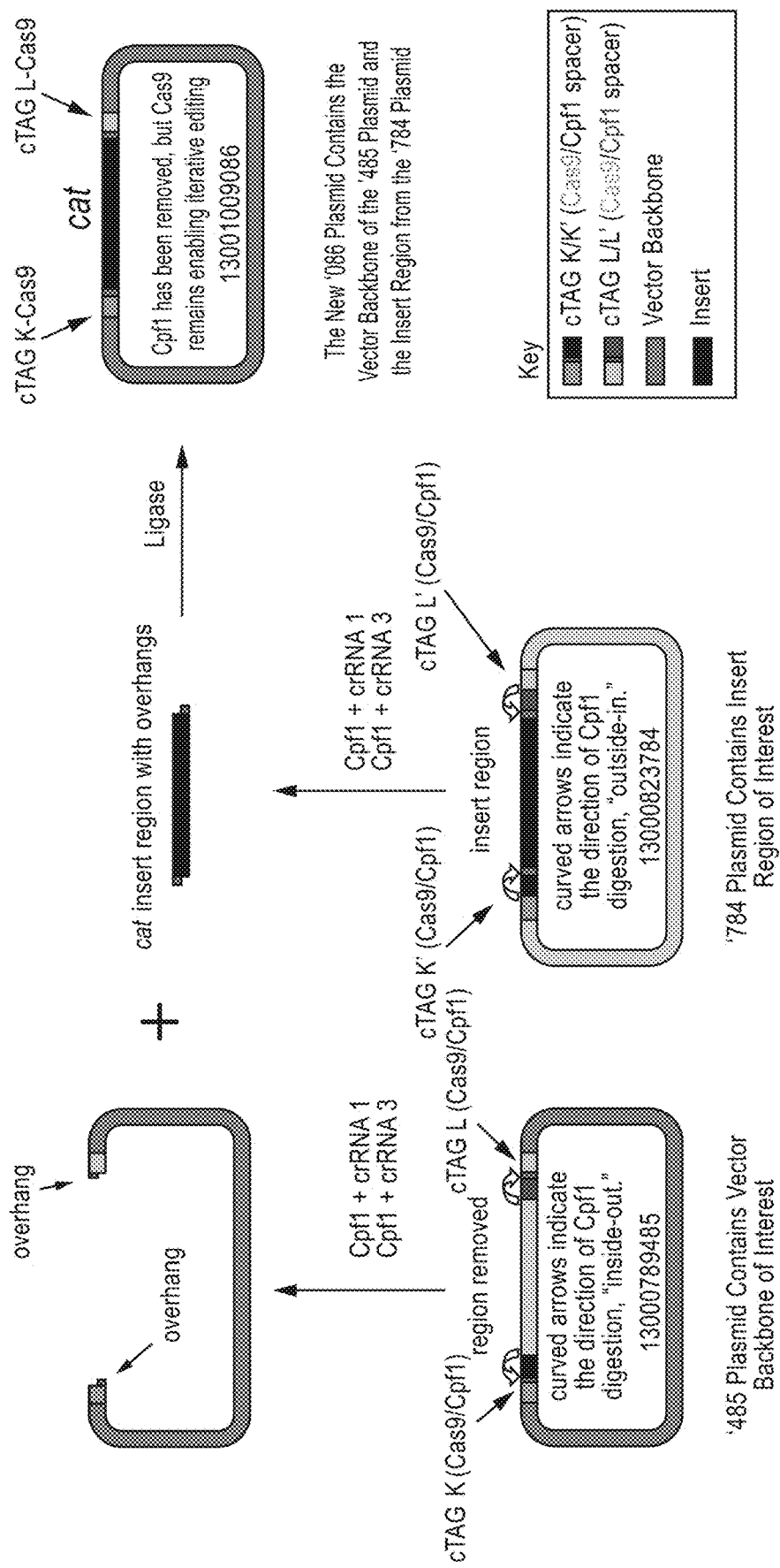
FIG. 4 Illustrates the one-pot in vitro modular CRISPR cloning of Example 1. Specifically, the generation of plasmid 13001009086 by transfer of an insert from one plasmid to another in a one-pot reaction is shown. The details of this reaction are set forth in Example 1.

Both plasmids carry cloning tags flanking the region of interest (cTAG K [SEQ ID NO: 78]/cTAG L [SEQ ID NO: 79] and cTAG K' [SEQ ID NO: 80]/cTAG L' [SEQ ID NO: 81]). In order to drive the cloning reaction towards the edited plasmid, the Cpf1 spacers are in opposite orientations on the recipient and donor plasmids (K/K' and L/L' respectively). This inside-out/outside-in digest removes the Cpf1 spacer in the final product, eliminating re-cutting of the desired product (see, curved arrows in FIG. 4, depicting inside-out digestion in the '485 plasmid and outside-in digestion in the '784 plasmid). The Cas9 spacers remain, enabling iterative editing at this site. Thus, the MegaModular construct allows for a rapid single-pot reaction scheme that enables iterative editing.

Cpf1 protein was synthesized by Genscript and the crRNAs by Synthego. For the one-pot cleavage/ligation reaction, the Cpf1 protein complexed with the crRNAs (crRNA 1 and crRNA 3), was added to the plasmids (13000789485—SEQ ID NO: 83 and 13000823784—SEQ ID NO: 84) and DNA ligase in buffer containing ATP. These components were cycled at temperatures optimized for cleavage and ligation.

The reaction was transformed into E. coli and positive clones were sequenced to confirm insertion of the new insert and loss of the Cpf1 spacers.

For deletions, the Cpf1 sites within cloning tags used must generate compatible overhangs to allow for plasmid closure. cTAG L' was designed to contain two Cpf1 spacers, one for insertion where the overhang is incompatible with cTAG K' and a second one for deletion where the overhang is compatible with cTAG K'.

Example 2: In Vitro Modular CRISPR Cloning

This example was designed to demonstrate the flexibility of CRISPR cloning. As an initial step, several resistance plasmids encoding for Kanamycin or Chloramphenicol resistance genes were created from source vectors pzHR039 (SEQ ID No: 100) and 13000223370 (SEQ ID No: 101), respectively. The Kanamycin resistance plasmids were each designed so as to include various Cpf1 landing sites flanking the GFP gene (when digested, these plasmids produce "the kanamycin resistant plasmid backbone"). The Chloramphenicol resistance plasmids were each designed so as to include various Cpf1 landing sites flanking the Chloramphenicol resistance gene (when digested, these plasmids produce "the chloramphenicol resistant insert"). Sequences and vector maps for each plasmid used in this Example are disclosed in Table 6.

Each Kanamycin and Chloramphenicol resistant plasmid was initially linearized with type-II restriction enzymes KpnI-HF and PvuI-HF, respectively (both commercially available from NEB). The location of the KpnI and PvuI restriction sites on each plasmid are noted in the vector maps provided in FIGS. 7-14. After linearization, the resistance plasmids were no longer capable of self-replication in a bacterial host system.

Linearized resistance plasmids were then mixed with a pre-incubated mixture of 15 µg (1.58 µM final concentration) of Cpf1 enzyme and 2 µL of 5 µM of each guide RNA described below (0.167 µM final concentration) in a 60 µL reaction to form active CRISPR complexes.

The Cpf1 enzyme used in this Example was commercially obtained from IDT. The Cpf1 was sourced from *Acidaminococcus* sp. Cpf1 (AsCpf1). The enzyme was further modified to comprise 1 N-terminal nuclear localization sequence (NLS) and 1 C-terminal NLSs, as well as 3 N-terminal FLAG tags and a C-terminal 6-His tag.

The guide RNAs used in this example were custom ordered from IDT. Each guide RNA was designed to target a different CRISPR landing site located within the linearized resistance plasmid. In this Example, the Cpf1 landing sites of the backbone plasmid were excised, but restored upon ligation of the insert. Table 6 provides the guide sequence portion of each guide RNA used. The CRISPR complexes in the mixture were thus designed to cleave out the GFP gene from each kanamycin resistant plasmid to generate kanamycin resistant plasmid backbones (see FIG. 5, second panel). The CRISPR complexes in the mixture were also designed to cleave out the chloramphenicol resistance gene from the chloramphenicol resistance plasmid to generate chloramphenicol resistant inserts (see FIG. 5, second panel). The kanamycin resistant plasmid backbone and the chloramphenicol resistant insert of each reaction were similarly designed to generate compatible overhangs that would result in hybridization of the ends to produce a "dual resistant" kanamycin and chloramphenicol plasmid.

The linearized resistance plasmid mixtures comprising the Cpf1 and guide RNAs were allowed to incubate for 3 hours at 37 degrees Celsius in the manufacturer's recommended Cpf1 buffer. Selected reactions were run on agarose gels and the resulting fragments were purified using standard DNA extraction kits (Zymo Research kit, used according to manufacturer's instructions). Purified (control) and unpurified (test).

DNA fragments comprising the kanamycin resistant plasmid backbone and the chloramphenicol resistant insert, each comprising two compatible Cpf1 sticky ends were combined in a new reactions with or without a T4 DNA ligase (commercially available form NEB) and transformed into NEB10-B cells (commercially available from NEB). Transformed cells were plated on media augmented with both Kanamycin and Chloramphenicol designed to prevent the growth of any cells that did not contain functional resistance plasmids.

Figure 5:
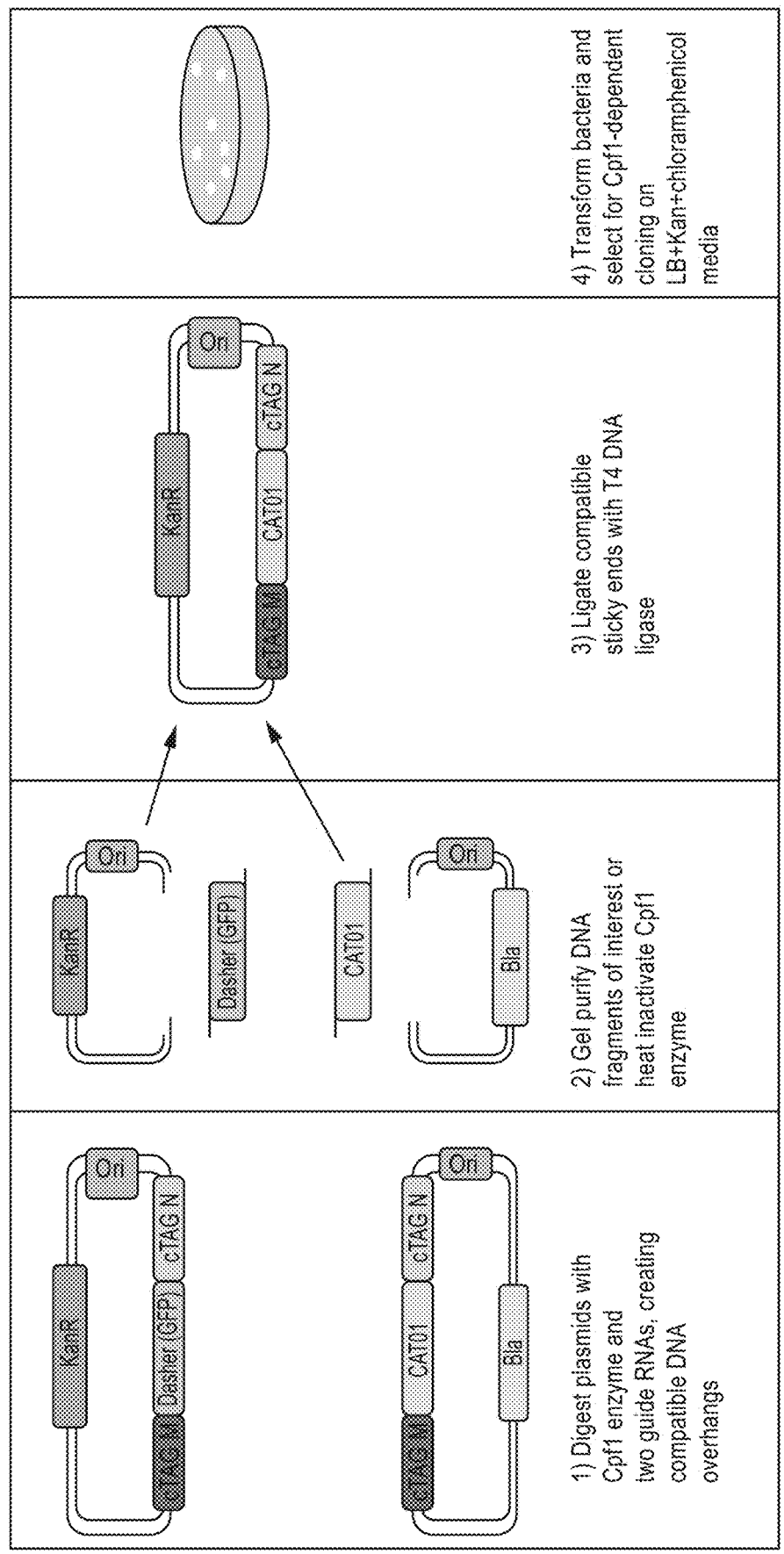
FIG. 5 Illustrates an embodiment of the in vitro modular CRISPR cloning methods of Example 2. Each panel provides an illustration of the experimental design described in Example 2. A chloramphenicol resistance gene was cloned into a kanamycin resistant backbone plasmid to create a dual resistance plasmid. Dual resistance plasmids were then transformed into bacteria, which was subsequently cultured in media augmented with kanamycin and chloramphenicol antibiotics. Resistant colonies indicated successful Cpf1 cloning assemblies.

Individual colonies were sent for Sanger sequencing to confirm junctions of Cpf1 cloning. Recovered colonies were also validated via PCR using primers described in Table 6. FIG. 5 illustrates the general experimental design described above, except that the plasmids were linearized prior to Cpf1 digestion, as described above.

TABLE 6

List of sequences used in this Example 2

| Component | Description | SEQ ID NO |
| --- | --- | --- |
| GFP Cpf1 cTAG M fwd | 5' *CAGCACCTGGATTACCCTGTTATCCCTAGT TTTGGGTTAAAGATGGTTAAATGAT*TCG AAAATAATAAAGGGAAAATCA 3' | SEQ ID No: 86 |
| GFP Cpf1 cTAG N fwd | 5' *CAGCACCTGGATTACCCTGTTATCCCTAGT TTTGGGATGTTAAGAGTCCCTATCT*TCG AAAATAATAAAGGGAAAATCA 3' | SEQ ID No: 87 |
| GFP Cpf1 cTAG P fwd | 5' *CAGCACCTGGATTACCCTGTTATCCCTAGT TTTGAGGAGTGTTCAGTCTCCGTGAAC*T CGAAAATAATAAAGGGAAAATCA 3' | SEQ ID No: 88 |
| GFP Cpf1 cTAG O rvs | 5' *CGCTTCCTCCTGAAAATGCAGCTAGGTAGT TTTGACCGCCCCCCCCATACCCCAA*TCG ACATGCCGAACTCAGAAGTGA 3' | SEQ ID No: 89 |
| GFP Cpf1 cTAG N rvs | 5' *CGCTTCCTCCTGAAAATGCAGCTAGGTAGT TTTGGGATGTTAAGAGTCCCTATCT*TCG ACATGCCGAACTCAGAAGTGA 3' | SEQ ID No: 90 |
| CAT01 Cpf1 cTAG M fwd | 5' *TTTGGGTTAAAGATGGTTAAATGAT*TCG ACATACACATAAAGTAGCTTGCG 3' | SEQ ID No: 91 |
| CAT01 Cpf1 cTAG N fwd | 5' *TTTGGGATGTTAAGAGTCCCTATCTTCGA* CATACACATAAAGTAGCTTGCG 3' | SEQ ID No: 92 |
| CAT01 Cpf1 cTAG P fwd | 5' *TTTGAGGAGTGTTCAGTCTCCGTGAACT CGA*CATACACATAAAGTAGCTTGCG 3' | SEQ ID No: 93 |
| CAT01 Cpf1 cTAG N rvs | 5' *TTTGGGATGTTAAGAGTCCCTATCT*TCG ACTGGAAGGACAAGGGGGACC 3' | SEQ ID No: 94 |
| CAT01 Cpf1 cTAG O rvs | 5' *TTTGACCGCCCCCCCCATACCCCAA*TCG ACTGGAAGGACAAGGGGGACC 3' | SEQ ID No: 95 |
| Cpf1 cTAG M | 5' TTTGGGTTAAAGATGGTTAAATGAT 3' | SEQ ID No: 96 |
| RNA targeting cTAG M | 5' UAAUUUCUACUCUUGUAGAU<u>GGUUAAAGAU GGUUAAAUGAU</u> 3' | SEQ ID NO: 110 |

TABLE 6-continued

List of sequences used in this Example 2

| Component | Description | SEQ ID NO |
|---|---|---|
| Cpf1 cTAG N | 5' TTTGGGATGTTAAGAGTCCCTATCT 3' | SEQ ID No: 97 |
| RNA targeting cTAG N | 5' UAAUUUCUACUCUUGUAGAUGGAUGUUAAG AGUCCCUAUCU 3' | SEQ ID NO: 111 |
| Cpf1 cTAG O | 5' TTTGACCGCCCCCCCCATACCCCAA 3' | SEQ ID No: 98 |
| RNA targeting cTAG O | 5' UAAUUUCUACUCUUGUAGAUACCGCCCCCC CCAUACCCCAA 3' | SEQ ID NO: 112 |
| Cpf1 cTAG P | 5' TTTGAGGAGTGTTCAGTCTCCGTGAAC 3' | SEQ ID No: 99 |
| RNA targeting cTAG P | 5' UAAUUUCUACUCUUGUAGAUAGGAGUGUUC AGUCUCCGUGAAC 3' | SEQ ID NO: 113 |
| pzHR039 | Source for Kanamycin resistance and GFP. See listing for full sequence | SEQ ID NO: 100 |
| 13000223370 | Source for Chloramphenicol resistance and GFP. See listing for full sequence | SEQ ID NO: 101 |
| pJDI427 | GFP Cpf1 cTAGs M and N KanR CENARS TRP1 see listing for full sequence | SEQ ID NO: 102 FIG. 7 |
| pJDI429 | GFP Cpf1 cTAGs N and O KanR CENARS TRP1 see listing for full sequence | SEQ ID NO: 103 FIG. 8 |
| pJDI430 | GFP Cpf1 cTAGs N and P KanR CENARS TRP1 see listing for full sequence | SEQ ID NO: 104 FIG. 9 |
| pJDI431 | GFP Cpf1 cTAGs O and P KanR CENARS TRP1 see listing for full sequence | SEQ ID NO: 105 FIG. 10 |
| pJDI432 | pJET AmpR CmR Cpf1 cTAGs M and N see listing for full sequence | SEQ ID NO: 106 FIG. 11 |
| pJDI434 | pJET AmpR CmR blunt Cpf1 cTAGs N and O see listing for full sequence | SEQ ID NO: 107 FIG. 12 |
| pJDI435 | pJET AmpR CmR blunt Cpf1 cTAGs N and P see listing for full sequence | SEQ ID NO: 108 FIG. 13 |
| pJDI436 | pJET AmpR CmR blunt Cpf1 cTAGs O and P see listing for full sequence | SEQ ID NO: 109 FIG. 14 |

***non-underlined portion of guide RNA for SEQ ID NOs: 110-113 is the chemically modified Alt-R RNA from IDT. The homologous region of sequence to the respective cTAGs (i.e. M-P) is underlined.

Figure 6:
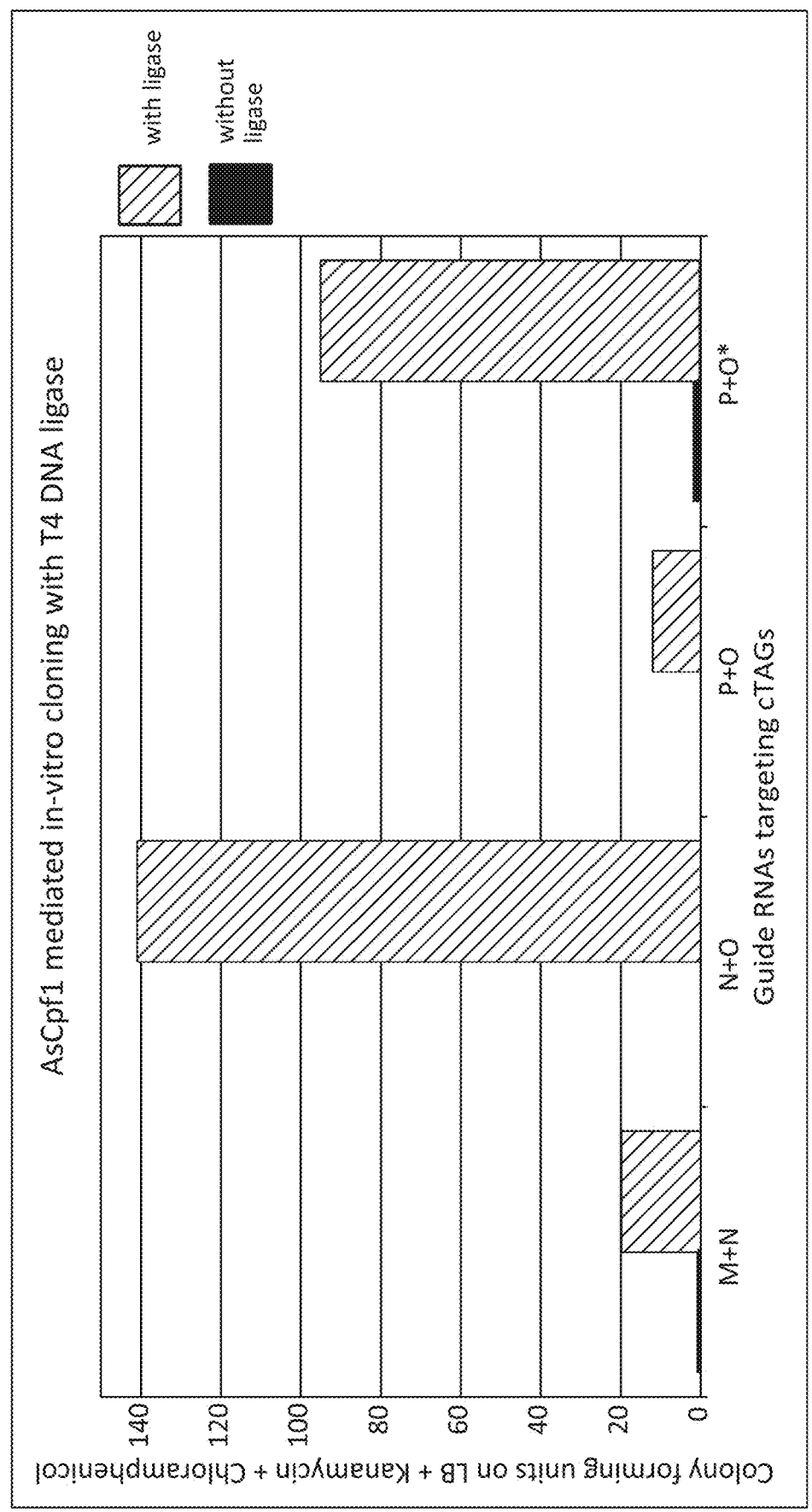
FIG. 6 Illustrates the results of the in vitro modular CRISPR cloning methods of Example 2. The y-axis represents the number of recovered colonies growing in media augmented with kanamycin and chloramphenicol. Resistant colonies indicate successful Cpf1 cloning assemblies. The results showed a ligase-dependent assembly of dual resistance plasmids.
Figure 7:
FIG. 7 Depicts the vector map for pJDI427. CRISPR landing sites used in the Cpf1 assembly are labeled as cTAG M and cTAG N. Relevant sequence information can be found in SEQ ID NO: 102.
Figure 8:
FIG. 8 Depicts the vector map for pJDI429. CRISPR landing sites used in the Cpf1 assembly are labeled as cTAG N and cTAG O. Relevant sequence information can be found in SEQ ID NO: 103.
Figure 9:
FIG. 9 Depicts the vector map for pJDI430. CRISPR landing sites used in the Cpf1 assembly are labeled as cTAG P and cTAG N. Relevant sequence information can be found in SEQ ID NO: 104.
Figure 10:
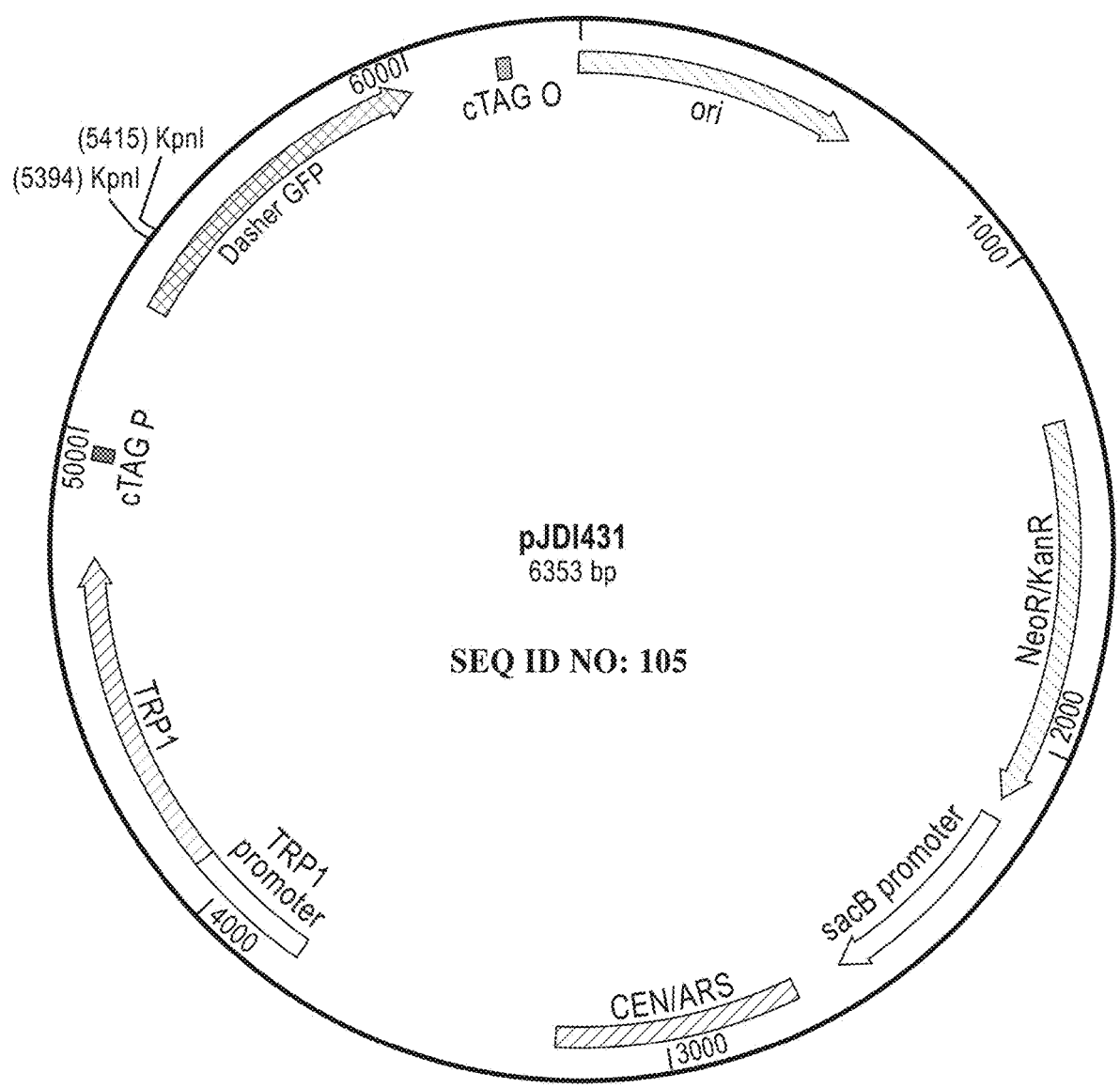
FIG. 10 Depicts the vector map for pJDI431. CRISPR landing sites used in the Cpf1 assembly are labeled as cTAG P and cTAG O. Relevant sequence information can be found in SEQ ID NO: 105.
Figure 11:
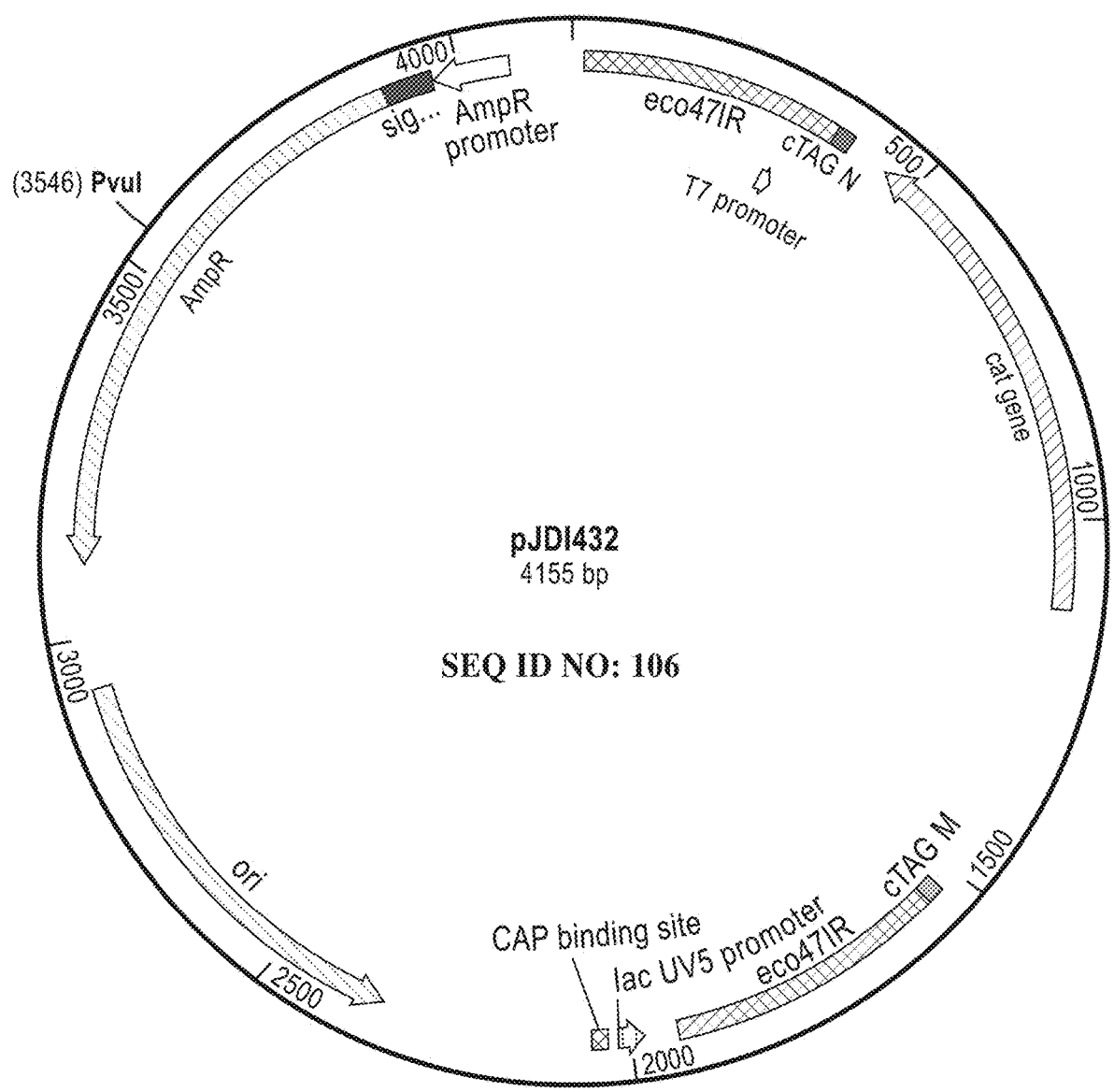
FIG. 11 Depicts the vector map for pJDI432. CRISPR landing sites used in the Cpf1 assembly are labeled as cTAG M and cTAG N. Relevant sequence information can be found in SEQ ID NO: 106.
Figure 12:
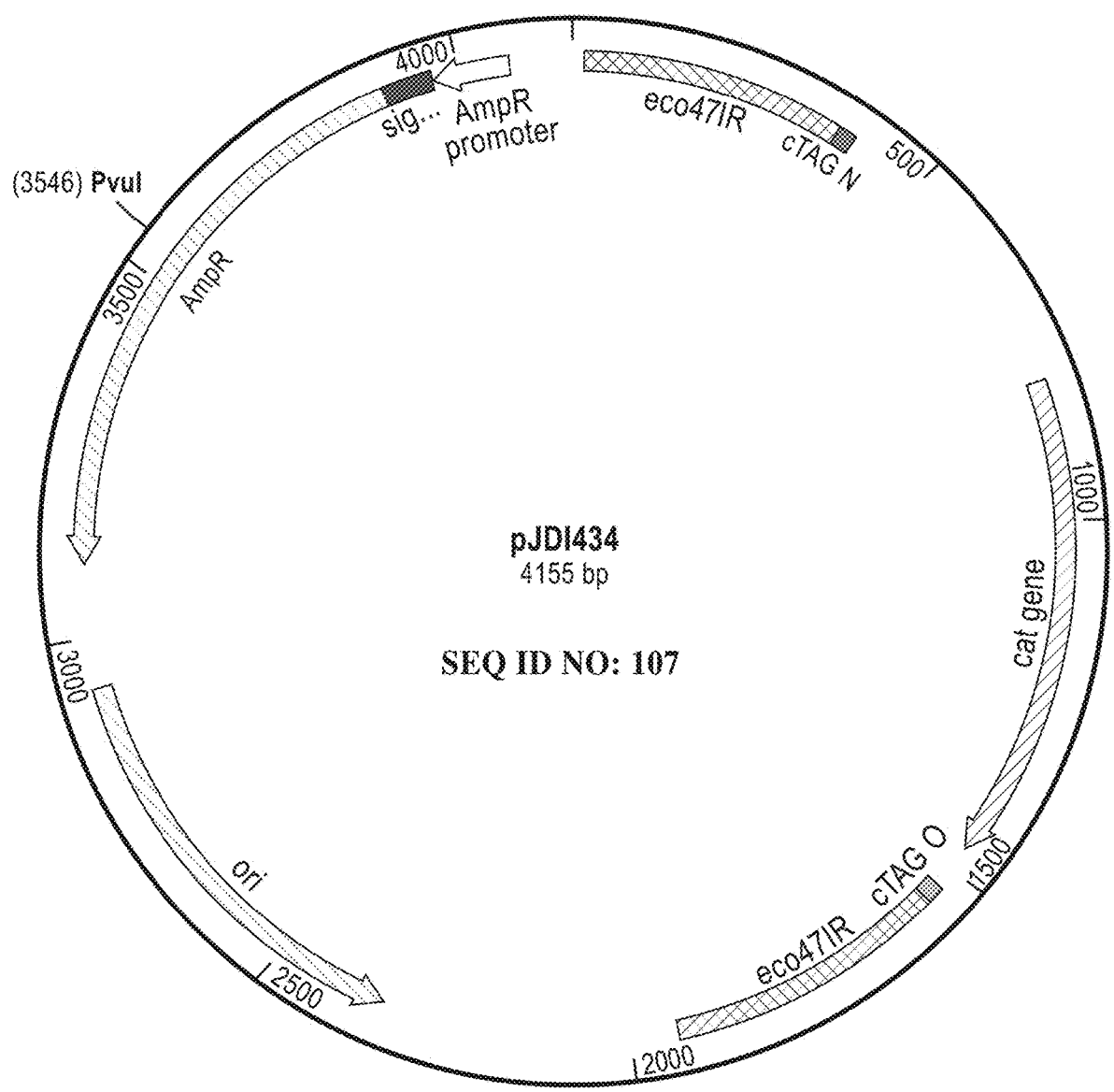
FIG. 12 Depicts the vector map for pJDI434. CRISPR landing sites used in the Cpf1C assembly are labeled as cTAG N and cTAG O. Relevant sequence information can be found in SEQ ID NO: 107.
Figure 13:
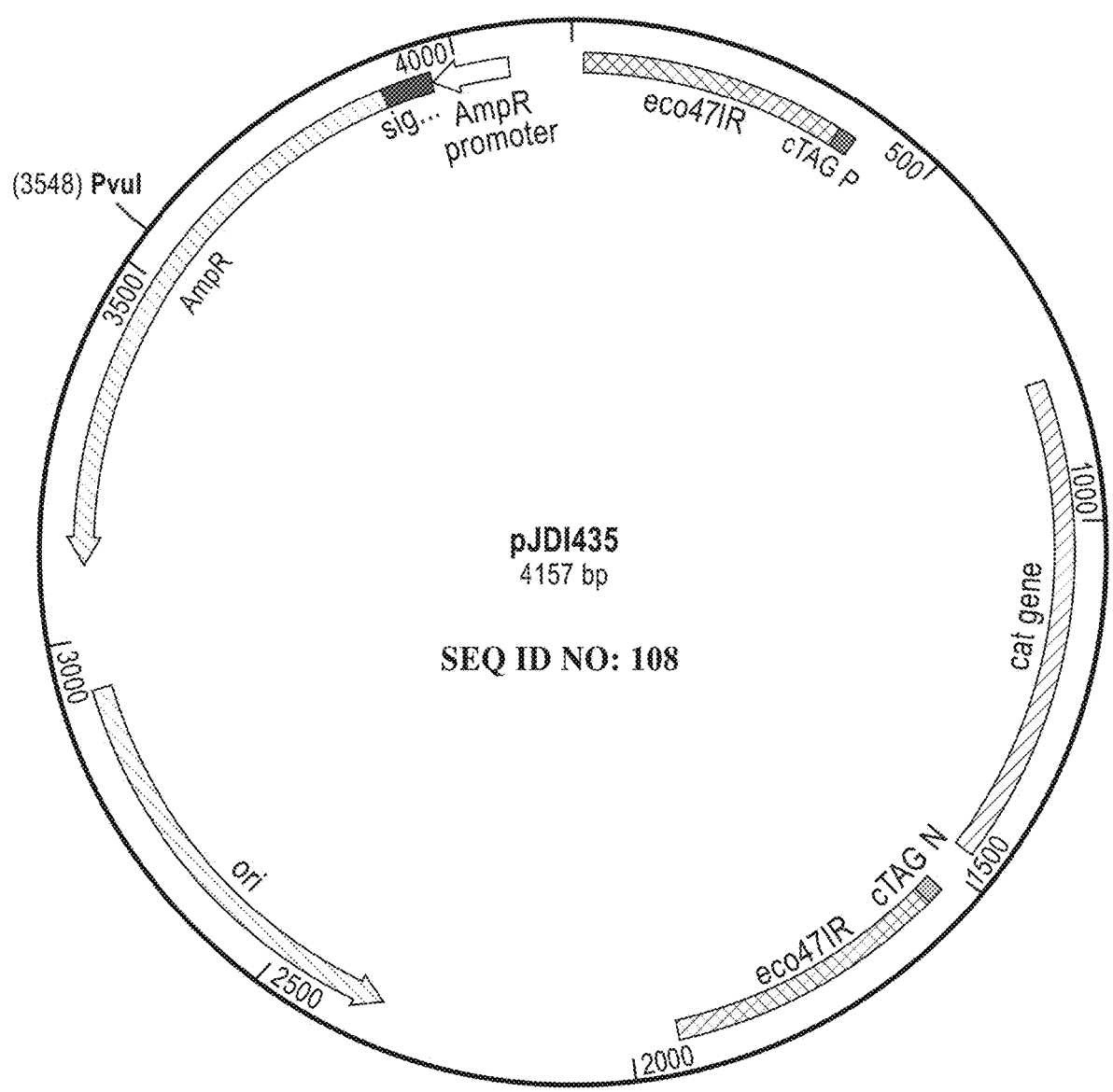
FIG. 13 Depicts the vector map for pJDI435. CRISPR landing sites used in the Cpf1 assembly are labeled as cTAG P and cTAG N. Relevant sequence information can be found in SEQ ID NO: 108.
Figure 14:
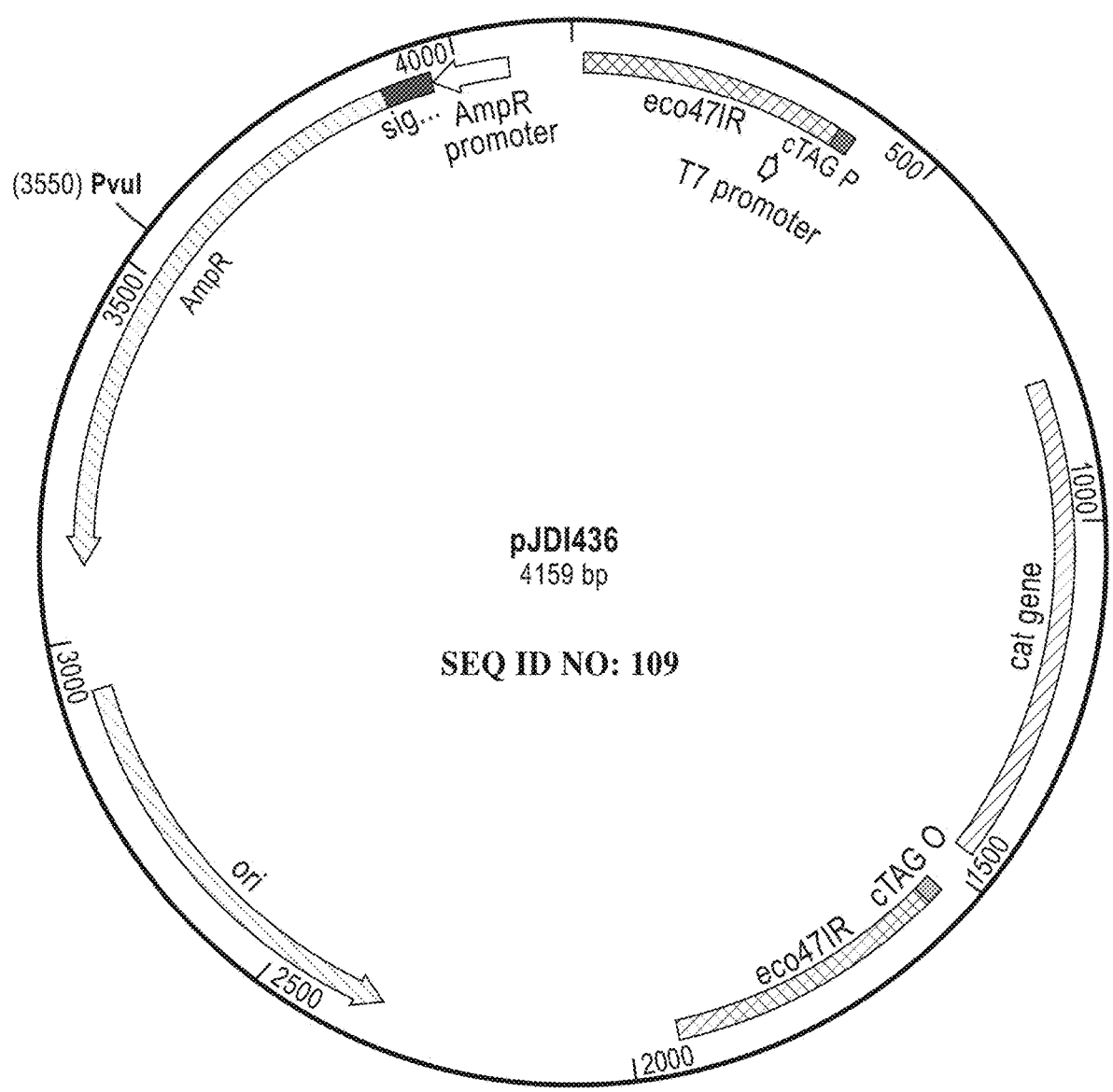
FIG. 14 Depicts the vector map for pJDI436. CRISPR landing sites used in the Cpf1 assembly are labeled as cTAG P and cTAG O. Relevant sequence information can be found in SEQ ID NO: 109.

The results of this experiment are shown in Table 7 and FIG. 6. Reaction numbers for each transformation are shown along the top row, with guide RNAs used listed along the left-hand column of Table 7. The comparison of identical Cpf1 reactions with and without ligase showed a 9.9-fold increase in transformants in the presence of ligase enzyme, indicating that colony growth was due to formation of the double kanamycin and chloramphenicol resistant plasmid after Cpf1 digestion. The no-ligase reactions are matched controls designed to establish that the reactions are specific, and were not simply due to the presence of contaminating levels of undigested resistance plasmids.

Sixteen individual colonies were Sanger sequenced to verify both the upstream and downstream cloning junctions. In seven of seven upstream sequenced junctions, and eight of nine downstream junctions, the Cpf1 mediated clones from the reactions with T4 DNA ligase indicated faithful digestion and ligation.

Reactions 71 and 72 were transformed with Cpf1 digested plasmids that were not subjected to DNA gel purification steps. Cpf1 enzyme however was heat inactivated according to supplier's instructions before addition of T4 DNA ligase (reaction 72). Reactions 71 and 72 exhibited the same ligase-dependency.

TABLE 7

Resistant Transformant Colonies Comprising Cpf1-edited vectors

| | 55 | 56 | 59 | 60 | 67 | 68 | 71* | 72* |
|---|---|---|---|---|---|---|---|---|
| Guides M + N | yes | yes | | | | | | |
| Guides N + O | | | yes | yes | | | | |
| Guides P + O | | | | | yes | yes | yes | yes |
| T4 Ligase | No | Yes | No | Yes | No | Yes | No | Yes |
| # of transformants (Kan Resistant Colonies) | 1 | 20 | 0 | 141 | 0 | 12 | 2 | 95 |

*Plates 71 and 72 were transformed with digested DNA that had not undergone DNA gel purification after Cpf1 digestion.

The disclosure of PCT/US2017/042245 (WO 2018/013990 A1, claiming priority to U.S. Provisional App. No. 62/362,909) is incorporated herein in its entirety.

Figure 15:
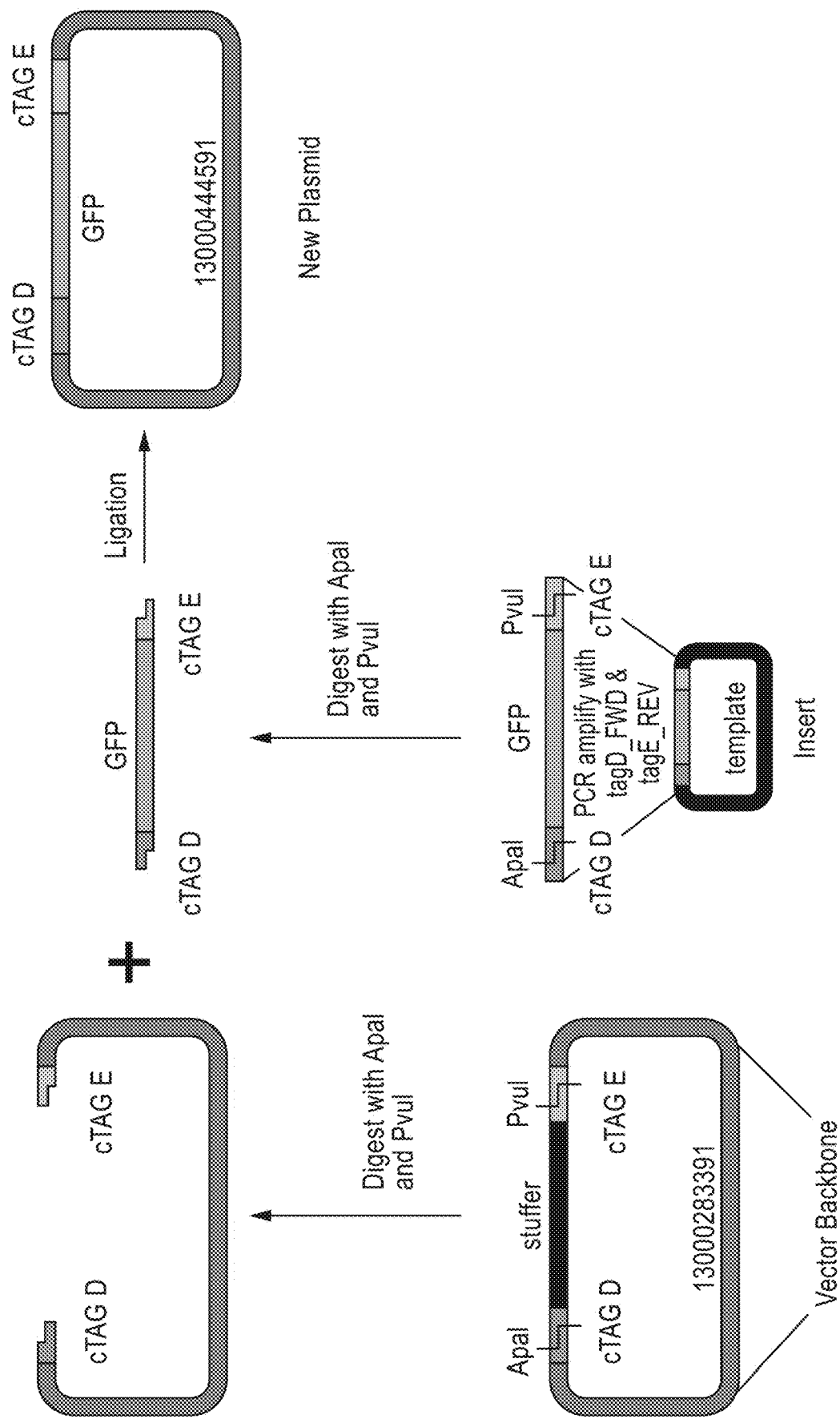
FIG. 15 Illustrates an example gene editing of a modular CRISPR construct, according to the methods of the present disclosure. Specifically.
Figure 16:
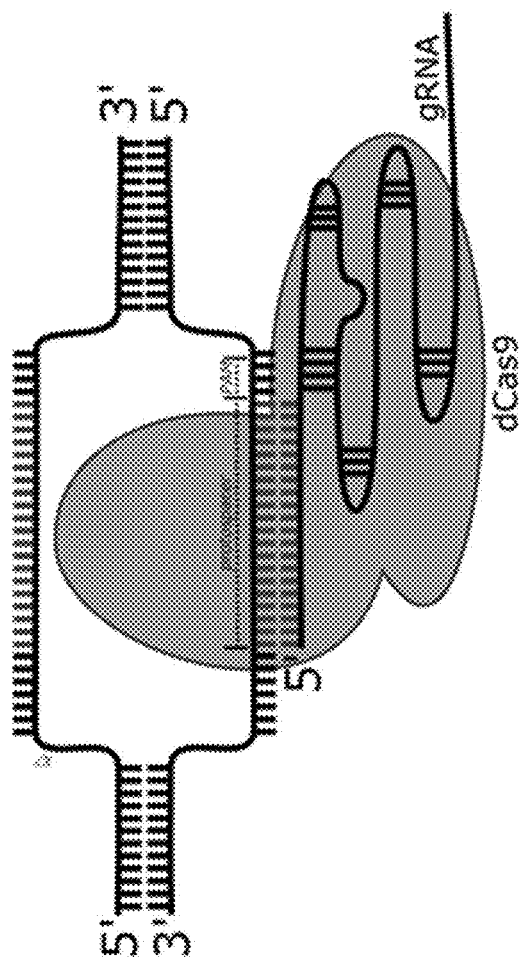
FIG. 16 Is a diagram illustrating the gRNA-directed binding of dCas9 to DNA.

Example 3: Plasmid Assembly by Restriction Enzyme Digestion and Ligation Using the MegaModular Design This example describes the genetic editing of a modular CRISPR vector, according to the methods of the present disclosure. FIG. 15 illustrates the genetic editing of modular CRISPR plasmid 13000444591 described in this example. The plasmid backbone was first prepared by removing a "stuffer" insert DNA part from a previously constructed plasmid. The stuffer insert DNA part was removed by digesting the stuffer part's flanking cloning tags (cTAGs) D (SEQ ID NO: 68) and E (SEQ ID NO: 69) with restriction enzymes ApaI and PvuI. The resulting fragments were separated via gel electrophoresis, and the desired 8.3 kb fragment corresponding to the plasmid backbone was excised from the gel and extracted using standard silica membrane columns.

To generate the new insert for the modular CRISPR vector, a desired insert DNA part flanked by cTAG D and cTAG E, was PCR amplified using universal cTAG oligos tagD_FWD (SEQ ID NO: 75) and tagE_REV (SEQ ID NO: 76). The resulting insert contained a GFP marker gene flanked by cTAG D and cTAG E. The resulting PCR fragment was digested with the ApaI enzyme that cuts within cTAG D and the PvuI enzyme that cuts within cTAG E sequence. The digested insert DNA part was purified using standard silica membrane columns.

The purified modular CRISPR vector backbone and insert DNA part were combined into a single reaction with a ligase to generate a circular plasmid. The sequence for the resulting edited GFP-containing plasmid 13000444591 is provided in (SEQ ID NO: 77).

Example 4: Plasmid Assembly by Yeast Homologous Recombination Using the MegaModular Design Plasmid 13000283399 (SEQ ID NO: 85) was assembled by yeast homologous recombination of PCR fragments flanked by MegaModular tags. The desired constructs for assembly were amplified by PCR in such a way that they were flanked by specific MegaModular tags. These tags allowed for directional assembly of fragments in *Saccharomyces cerevisiae* as the tags themselves served as the overlapping homologous region for homologous recombination. Specifically, 5 fragments were amplified via PCR flanked by MegaModular tags as follows: tag A-Fragment 1-tag B; tag B-Fragment 2-tag C; tag C-Fragment 3-tag D; tag D-Fragment 4-tag E; and tag E-Fragment 5-tag F. These fragments, along with a linearized assembly vector containing a yeast origin of replication and a TRP auxotrophic selection marker as well as tag A at one end and tag F at the other, were transformed into *S. cerevisiae*. Circularized, assembled plasmids were selected by *S. cerevisiae* growth in media lacking tryptophan. These plasmids were recovered and amplified in *Escherichia coli*, and correct conformation was confirmed by sequencing.

Example 5: CRISPRi Validation in *Corynebacterium*

The CRISPRi methods of the present disclosure were tested in the non-canonical species of *Corynebacterium glutamicum*. The components of the CRISPRi system were cloned into a single test vector encoding for a dCas9 and a guide RNA. The guide RNA in the test vector was designed to target the promoter region of a second construct that operably linked the targeted promoter to a gene encoding for a "paprika" Red Fluorescent Protein (RFP). A second control vector in which the guide RNA was a separate sequence not targeting the paprika RFP was generated.

Figure 17A:
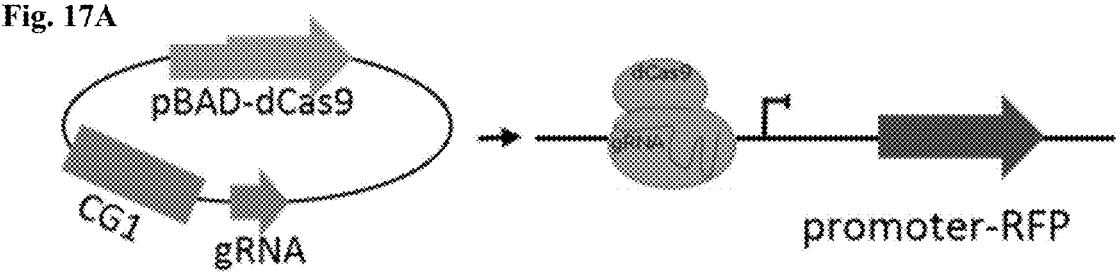
FIG. 17A—is diagram of the dCas9 expression vector leading to transcriptional inactivation of a target gene.
Figure 17B:
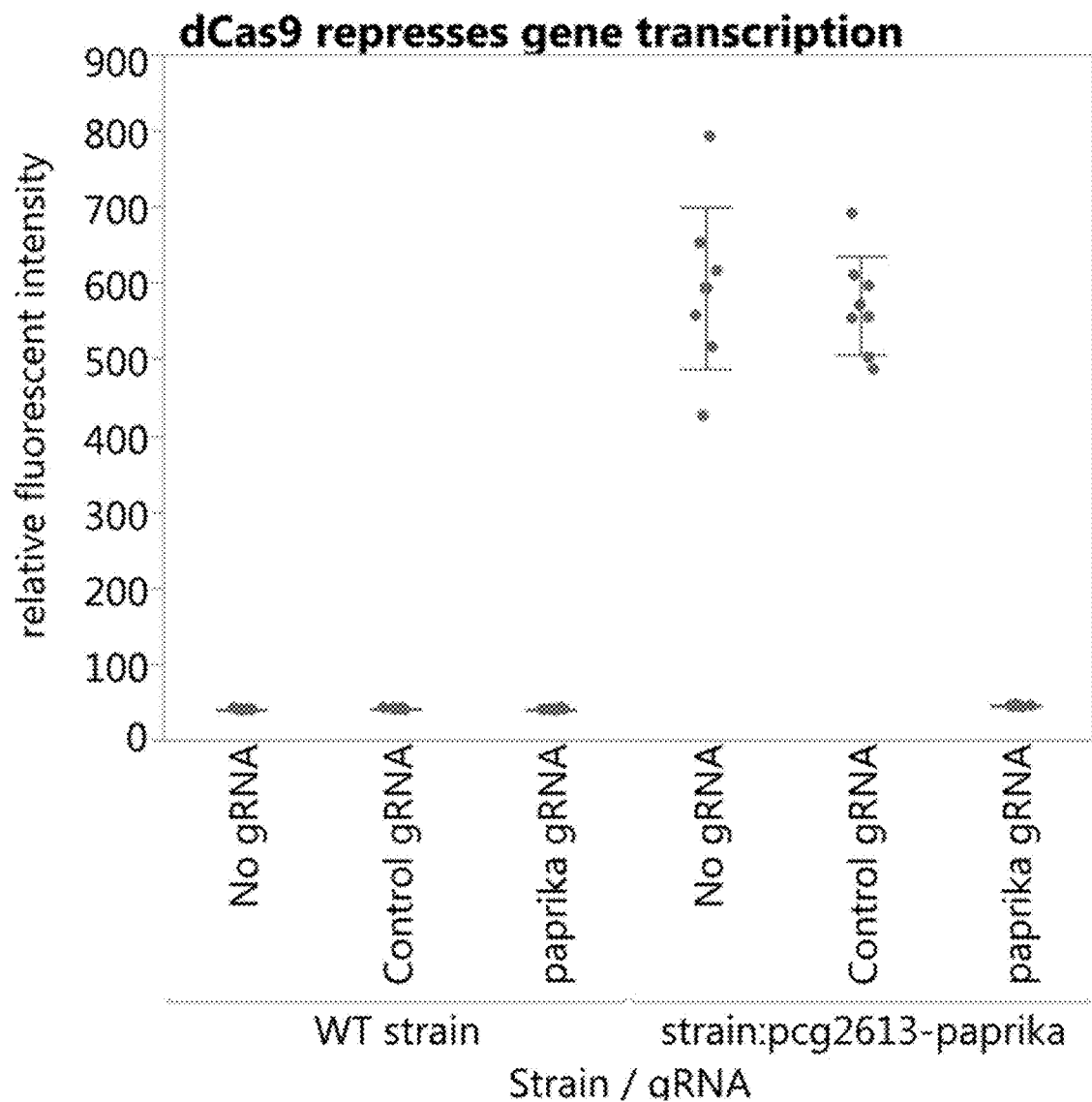
FIG. 17B—depicts the repression of gene transcription using a dCas9 expressed concurrently with various guide RNAs expressed in a WT or paprika producing strain. The median fluorescence of live gated cells, for 7 biological replicates, is shown.

The test and control vectors described above were transformed into both a wild type (WT) *C. glutamicum* strain, and a pcg2613-paprika strain, comprising the promoter-RFP construct described above as well as a WT strain, lacking the RFP construct (see experimental design in FIG. 17A). Cultures were grown at 30 degrees C. for 48 hours in media supplemented with 2% arabinose, to induce dCas9 via the pBAD promoter. The median fluorescence of live gated cells, for 7 biological replicates, was then recorded. The results of this experiment are shown on FIG. 17B. None of the WT strains exhibited any RFP fluorescence. Pcg2613 strains containing the control CRISPRi plasmids exhibited normal levels of RFP fluorescence. The test CRISPRi plasmid however, was successful at knocking down the expression of the RFP gene.

Further Embodiments of the Invention

Other subject matter contemplated by the present disclosure is set out in the following numbered embodiments:
1. A recombinant modular CRISPR DNA construct for modulating the expression of a host cell gene, said construct comprising a CRISPR multi-clonal site, said multi-clonal site comprising:
  a) at least two distinct cloning tags (cTAGs), wherein each cTAG comprises:
    i) one or more validated CRISPR landing sites, each comprising a protospacer sequence operably linked to a protospacer adjacent motif (PAM); wherein at least one of said validated CRISPR landing sites is unique within the modular CRISPR DNA construct; and
  b) one or more DNA insert part(s);
    i) wherein each of said distinct cTAGs are distributed in flanking positions around each of the one or more DNA insert part(s);
wherein the construct further comprises:
  c) a first nucleic acid encoding a catalytically inactivated CRISPR enzyme;
  d) a second nucleic acid encoding a guide RNA capable of recruiting the catalytically inactivated CRISPR enzyme of (c) to a DNA target site.
1.1. The recombinant modular CRISPR DNA construct of embodiment 1, wherein the modular CRISPR DNA construct comprises a first origin of replication.
1.2. The recombinant modular CRISPR DNA construct of any one of embodiments 1-1.1, wherein the modular CRISPR DNA construct comprises more than one origin of replication.
1.3. The recombinant modular CRISPR DNA construct of any one of embodiments 1-1.2, wherein the modular CRISPR DNA construct comprises a first origin of replication and a second origin of replication.
1.4. The recombinant modular CRISPR DNA construct of any one of embodiments 1.1 and 1.3, wherein the first origin of replication is capable of maintaining the plasmid in *E. coli*.
1.5. The recombinant modular CRISPR DNA construct of any one of embodiments 1.1, 1.3, and 1.4, wherein the second origin of replication is capable of maintaining the plasmid in *Corynebacterium glutamicum*.

1.6. The recombinant modular CRISPR DNA construct of any one of embodiments 1-1.4, wherein the first origin of replication is capable of maintaining the plasmid in *E. coli*, a second origin of replication is capable of maintaining the plasmid in *Saccharomyces cerevisiae* and a third origin of replication is capable of maintaining the plasmid in a *Corynebacterium glutamicum*.

1.7. The recombinant modular CRISPR DNA construct of any one of embodiments 1-1.6, wherein the modular CRISPR DNA construct comprises an insert part that encodes for a selectable marker.

1.8 The recombinant modular CRISPR DNA construct of any one of embodiments 1-1.7, wherein at least one origin of replication is comprised within an insert part within the CRISPR multi-clonal site.

2. The recombinant modular CRISPR DNA construct of any one of embodiments 1-1.8, wherein the first nucleic acid is comprised within an insert part within the CRISPR multi-clonal site.

3. The recombinant modular CRISPR DNA construct of embodiment 2, wherein the insert part comprising the first nucleic acid further comprises a selectable marker.

4. The recombinant modular CRISPR DNA construct of any one of embodiments 1-3, wherein the second nucleic acid is comprised within an insert part within the CRISPR multi-clonal site.

5. The recombinant modular CRISPR DNA construct of embodiment 4, wherein the insert part comprising the second nucleic acid further comprises a selectable marker.

6. The recombinant modular CRISPR DNA construct of any one of embodiments 1-1.8, wherein the first nucleic acid and the second nucleic acid are each comprised within their own insert part within the CRISPR multi-clonal site.

7. The recombinant modular CRISPR DNA construct of embodiment 6, wherein the insert parts comprising the first nucleic acid and the second nucleic acid each comprise a selectable marker.

8. The recombinant modular CRISPR DNA construct of any one of embodiments 5-7, wherein the selectable marker comprised in the insert part comprising the first nucleic acid and the selectable marker comprised in the insert part comprising the second nucleic acid are different.

9. The recombinant modular CRISPR DNA construct of any one of embodiments 1-5, wherein the first nucleic acid and the second nucleic acid are comprised within the same insert part within the CRISPR multi-clonal site.

10. The recombinant modular CRISPR DNA construct of any one of embodiments 1-9, wherein the first nucleic acid is operably linked to a promoter.

10.1 The recombinant modular CRISPR DNA construct of any one of embodiments 1-10, wherein the first nucleic acid is operably linked to a terminator.

11. The recombinant modular CRISPR DNA construct of any one of embodiments 1-10.1, wherein the second nucleic acid is operably linked to a promoter.

11.1 The recombinant modular CRISPR DNA construct of any one of embodiments 1-11, wherein the second nucleic acid is operably linked to a terminator.

12. The recombinant modular CRISPR DNA construct of any one of embodiments 10-11.1, wherein the promoter is a heterologous promoter.

12.1 The recombinant modular CRISPR DNA construct of any one of embodiments 10-12, wherein the promoter is a constitutive promoter.

12.2 The recombinant modular CRISPR DNA construct of any one of embodiments 10-12, wherein the promoter is an inducible promoter.

13. The recombinant modular CRISPR DNA construct of any one of embodiments 1-12.2, wherein the first nucleic acid encodes a catalytically inactivated CRISPR enzyme that is translationally fused to a transcriptional activation protein.

13.1 The recombinant modular CRISPR DNA construct of any one of embodiments 1-12.2, wherein the first nucleic acid encodes a catalytically inactivated CRISPR enzyme that is translationally fused to a transcriptional inactivation protein.

13.2 The recombinant modular CRISPR DNA construct of any one of embodiments 1-12.2, wherein the first nucleic acid encodes a catalytically inactivated CRISPR enzyme that is translationally fused to a transcriptional repressor.

14. The recombinant modular CRISPR DNA construct of any one of embodiments 1-12.2, wherein the construct further comprises (e) a third nucleic acid encoding a transcriptional activation protein that, when expressed, is capable of attaching itself to the catalytically inactivated CRISPR enzyme.

14.1 The recombinant modular CRISPR DNA construct of any one of embodiments 1-12.2, wherein the construct further comprises (e) a third nucleic acid encoding a transcriptional inactivation protein that, when expressed, is capable of attaching itself to the catalytically inactivated CRISPR enzyme.

14.2 The recombinant modular CRISPR DNA construct of any one of embodiments 1-12.2, wherein the construct further comprises (e) a third nucleic acid encoding a transcriptional repressor protein that, when expressed, is capable of attaching itself to the catalytically inactivated CRISPR enzyme.

15. The recombinant modular CRISPR DNA construct of embodiment 14, wherein the transcriptional activation protein attaches itself to the catalytically inactivated CRISPR enzyme via a linking aptamer, or through protein-protein interactions.

15.1 The recombinant modular CRISPR DNA construct of embodiment 14.1, wherein the transcriptional inactivation protein attaches itself to the catalytically inactivated CRISPR enzyme via a linking aptamer, or through protein-protein interactions.

15.2 The recombinant modular CRISPR DNA construct of embodiment 14.2, wherein the transcriptional repressor protein attaches itself to the catalytically inactivated CRISPR enzyme via a linking aptamer, or through protein-protein interactions.

16. The recombinant modular CRISPR DNA construct of any one of embodiments 1-12.2, wherein the second nucleic acid encodes a guide RNA that is operably linked to an aptamer capable of attaching itself to a transcriptional activation protein.

16.1 The recombinant modular CRISPR DNA construct of any one of embodiments 1-12.2, wherein the second nucleic acid encodes a guide RNA that is operably linked to an aptamer capable of attaching itself to a transcriptional inactivation protein.

16.2 The recombinant modular CRISPR DNA construct of any one of embodiments 1-12.2, wherein the second nucleic acid encodes a guide RNA that is operably linked to an aptamer capable of attaching itself to a transcriptional repressor protein.

17. The recombinant modular CRISPR DNA construct of any one of embodiments 13, 14, 15, and 16, wherein the transcriptional activation protein is selected from the group consisting of: VP16, VP64, and VP160, VPR.

17.1 The recombinant modular CRISPR DNA construct of any one of embodiments 13.1, 14.1, 15.1, and 16.1, wherein the transcriptional inactivation protein is selected from the group consisting of: Mxi1, Tbx3, KRAB, EnR, and SID.

17.2 The recombinant modular CRISPR DNA construct of any one of embodiments 13.2, 14.2, 15.2, and 16.2, wherein the transcriptional repressor protein is selected from the group consisting of: Mxi1, Tbx3, KRAB, EnR, and SID.

18. The recombinant modular CRISPR DNA construct of any one of embodiments 1-17.2, wherein said modular CRISPR DNA construct is circular.

19. The recombinant modular CRISPR DNA construct of any one of embodiments 1-17.2, wherein said modular CRISPR DNA construct is linear.

20. The recombinant modular CRISPR DNA construct of any one of embodiments 1-17.2, wherein said modular CRISPR DNA construct is integrated into the genome of an organism.

21. The recombinant modular CRISPR DNA construct of any one of embodiments 1-20, wherein at least one of said distinct cTAGs comprises at least two validated CRISPR landing sites.

22. The recombinant modular CRISPR DNA construct of any one of embodiments 1-21, wherein at least one of the CRISPR landing sites is for a Cas9 endonuclease.

23. The recombinant modular CRISPR DNA construct of any one of embodiments 1-22, wherein at least one of the CRISPR landing sites is for a Cpf1 endonuclease.

24. The recombinant modular CRISPR DNA construct of any one of embodiments 1-23, wherein at least one of said distinct cTAGs comprises a rare (≥8 bases long) restriction endonuclease site.

24.1 The recombinant modular CRISPR DNA construct of any one of embodiments 1-23, wherein each cTAGs comprises a rare (≥8 bases long) restriction endonuclease site.

25. The modular CRISPR DNA construct of any one of embodiments 1-24.1, wherein the catalytically inactivated CRISPR enzyme is a mutated Cas9 endonuclease.

26. The recombinant modular CRISPR DNA construct of any one of embodiments 1-24.1, wherein the catalytically inactivated CRISPR enzyme is a mutated Cpf1 endonuclease.

27. The modular CRISPR DNA construct of any one of embodiments 1-24.1, wherein the catalytically inactivated CRISPR enzyme is selected from amongst the dCas9 genes included in the vectors of Table 1.

28. The modular CRISPR DNA construct of any one of embodiments 1-24.1, wherein the catalytically inactivated CRISPR enzyme is selected from the group consisting of *Francisella novicida* (UniProtKB-A0Q7Q2 (CPF1_FRATN)), Lachnospiraceae bacterium (UniProtKB-A0A182DWE3 (A0A182DWE3_9FIRM)), and *Acidaminococcus* sp. (UniProtKB-U2UMQ6 (CPF1 ACISB).

29. The modular CRISPR DNA construct of any one of embodiments 1-24.1, wherein the catalytically inactivated CRISPR enzyme is AsCpf1 (D908A).

30. The recombinant modular CRISPR DNA construct of any one of embodiments 1-26, wherein the recombinant modular CRISPR DNA construct encodes for more than one guide RNA capable of recruiting the catalytically inactivated CRISPR enzyme of (c) to a DNA target site.

31. The recombinant modular CRISPR DNA construct embodiment 30, wherein at least one of the guide RNAs comprises a different sequence than another guide RNA encoded in the construct.

32. The recombinant modular CRISPR DNA construct of embodiment 30 or 31, wherein at least one of the guide RNAs targets a different DNA target site sequence than another guide RNA encoded in the construct.

33. The recombinant modular CRISPR DNA construct of any one of embodiments 1-32, wherein the recombinant modular CRISPR DNA construct encodes for more than one catalytically inactivated CRISPR enzyme.

34. The recombinant modular CRISPR DNA construct of embodiment 33, wherein at least one of the catalytically inactivated CRISPR enzymes comprises a different sequence than another catalytically inactivated CRISPR enzyme encoded in the construct.

35. The insert parts of any one of embodiments 1-34, wherein one or more of the cTAGs is selected from the group consisting of SEQ ID NO: 65-74, 78-81, and combinations thereof.

35.5. A host cell comprising the recombinant modular CRISPR DNA construct of any one of embodiments 1-35.

36. A high throughput method of modulating the expression of one or more host cell genes, said method comprising the step of introducing the recombinant modular CRISPR DNA construct of any one of embodiments 1-35 into the host cell; wherein the DNA target site of the guide RNA is located within the host cell genome.

37. The high throughput method of embodiment 36, wherein at least one insert part of the recombinant modular CRISPR DNA construct is integrated into the genome of the host cell.

38. The high throughput method of embodiment 36, wherein the recombinant modular CRISPR DNA construct remains in the host cell as extra chromosomal DNA.

39. The high throughput method of embodiment 36, wherein the recombinant modular CRISPR DNA construct of any one of embodiments 10-12.2 is introduced into the host cell.

40. The high throughput method of embodiment 39, further comprising the step of contacting the host cell with a compound capable of increasing expression of the inducible promoter.

41. A recombinant modular CRISPR DNA construct for screening CRISPR enzyme variants, said construct comprising a CRISPR multi-clonal site, said multi-clonal site comprising:
    a) at least two distinct cloning tags (cTAGs), wherein each cTAG comprises:
        i) one or more validated CRISPR landing sites, each comprising a protospacer sequence operably linked to a protospacer adjacent motif (PAM); wherein at least one of said validated CRISPR landing sites is unique within the modular CRISPR DNA construct; and
    b) one or more DNA insert part(s);
        i) wherein each of said distinct cTAGs are distributed in flanking positions around each of the one or more DNA insert part(s);
wherein the construct further comprises:
    c) a first nucleic acid encoding a protein;
    d) a second nucleic acid encoding a guide RNA capable of binding to a DNA target site.

41.1 A recombinant modular CRISPR DNA construct for screening CRISPR enzyme variants, said construct comprising a CRISPR multi-clonal site, said multi-clonal site comprising:
    a) at least two distinct cloning tags (cTAGs), wherein each cTAG comprises:
        i) one or more validated CRISPR landing sites, each comprising a protospacer sequence operably linked to a protospacer adjacent motif (PAM); wherein at least one of said validated CRISPR landing sites is unique within the modular CRISPR DNA construct; and b) one or more DNA insert part(s);
i) wherein each of said distinct cTAGs are distributed in flanking positions around each of the one or more DNA insert part(s);

wherein the construct further comprises:
c) a first nucleic acid encoding a CRISPR enzyme, or an enzyme suspected of having CRISPR functionality ("putative CRISPR enzyme");
d) a second nucleic acid encoding a guide RNA capable of binding to a DNA target site.

41.2. A host cell comprising the recombinant modular CRISPR DNA construct of embodiments 41 or 41.1.

42. A high throughput method of screening CRISPR enzyme variants, said method comprising the steps of:
a) introducing the recombinant modular CRISPR DNA construct of embodiment 41 or 41.1 into a host cell; wherein the DNA target site of the guide RNA is located within the host cell genome; and
b) measuring the degree of DNA cleavage occurring at the DNA target site.

43. A recombinant modular CRISPR DNA construct for modulating the expression of a host cell gene or engineering the host cell's genome, said construct comprising a CRISPR multi-clonal site, said multi-clonal site comprising:
a) at least two distinct cloning tags (cTAGs), wherein each cTAG comprises:
i) one or more validated CRISPR landing sites, each comprising a protospacer sequence operably linked to a protospacer adjacent motif (PAM); wherein at least one of said validated CRISPR landing sites is unique within the modular CRISPR DNA construct; and
b) one or more DNA insert part(s);
i) wherein each of said distinct cTAGs are distributed in flanking positions around each of the one or more DNA insert part(s); and wherein the one or more DNA insert part(s) comprises DNA encoding for a modulator of CRISPR function.

44. The recombinant modular CRISPR DNA construct of embodiment 43, wherein the insert part comprising the DNA encoding for a modulator of CRISPR function further comprises a selectable marker.

45. The recombinant modular CRISPR DNA construct of embodiments 43 or 44, wherein the modulator of CRISPR function is selected from the group consisting of: an origin of replication, a selectable marker, a counterselectable marker, an anti-CRISPR protein, a promoter, a terminator, a dCas9 protein, a dCpf1 protein, a barcode, a Cas9 protein, a Cpf1 protein, a DNA donor, and a protein that facilitates multiplexed genome editing.

46. A host cell comprising the recombinant modular CRISPR DNA construct of any one of embodiments 43-45.

47. The host cell of embodiment 46, wherein the host cell comprises a nucleic acid molecule encoding a catalytically active CRISPR enzyme and a guide RNA capable of recruiting the catalytically active CRISPR enzyme to a DNA target site.

48. The host cell of embodiment 46, wherein the host cell comprises a nucleic acid molecule encoding a catalytically inactivated CRISPR enzyme and a guide RNA capable of recruiting the catalytically inactivated CRISPR enzyme to a DNA target site.

49. The host cell of embodiment 48, wherein the catalytically inactivated CRISPR enzyme is translationally fused to a transcriptional activation protein.

49.1 The host cell of embodiment 48, wherein the catalytically inactivated CRISPR enzyme is translationally fused to a transcriptional inactivation protein.

49.2 The host cell of embodiment 48, wherein the catalytically inactivated CRISPR enzyme is translationally fused to a transcriptional repressor protein.

50. The host cell of embodiment 48, wherein the host cell further comprises nucleic acid molecule encoding a transcriptional activation protein that, when expressed, is capable of attaching itself to the catalytically inactivated CRISPR enzyme.

50.1 The host cell of embodiment 48, wherein the host cell further comprises nucleic acid molecule encoding a transcriptional inactivation protein that, when expressed, is capable of attaching itself to the catalytically inactivated CRISPR enzyme.

50.2 The host cell of embodiment 48, wherein the host cell further comprises nucleic acid molecule encoding a transcriptional repressor protein that, when expressed, is capable of attaching itself to the catalytically inactivated CRISPR enzyme.

51. The host cell of embodiment 50, wherein the transcriptional activation protein attaches itself to the catalytically inactivated CRISPR enzyme via a linking aptamer, or through protein-protein interactions.

51.1 The host cell of embodiment 50.1, wherein the transcriptional inactivation protein attaches itself to the catalytically inactivated CRISPR enzyme via a linking aptamer, or through protein-protein interactions.

51.2 The host cell of embodiment 50.2, wherein the transcriptional repressor protein attaches itself to the catalytically inactivated CRISPR enzyme via a linking aptamer, or through protein-protein interactions.

52. The host cell of embodiment 51, wherein the guide RNA is operably linked to an aptamer capable of attaching itself to a transcriptional activation protein.

52.1 The host cell of embodiment 51.1, wherein the guide RNA is operably linked to an aptamer capable of attaching itself to a transcriptional inactivation protein.

52.2 The host cell of embodiment 51.3, wherein the guide RNA is operably linked to an aptamer capable of attaching itself to a transcriptional repressor protein.

53. The host cell of any one of embodiments 49, 51, and 52, wherein the transcriptional activation protein is selected from the group consisting of: VP16, VP64, and VP160, VPR.

53.1 The host cell of any one of embodiments 49.1, 51.1, and 52.1, wherein the transcriptional inactivation protein is selected from the group consisting of: Mxi1, Tbx3, KRAB, EnR, and SID.

53.2 The host cell of any one of embodiments 49.2, 51.2, and 52.2, wherein the transcriptional activation protein is selected from the group consisting of: Mxi1, Tbx3, KRAB, EnR, and SID.

54. The recombinant modular CRISPR DNA construct of any one of embodiments 43-45, wherein said modular CRISPR DNA construct is circular.

55. The recombinant modular CRISPR DNA construct of any one of embodiments 43-45, wherein said modular CRISPR DNA construct is linear.

56. The recombinant modular CRISPR DNA construct of any one of embodiments 43-45, wherein said modular CRISPR DNA construct is integrated into the genome of an organism.

57. The recombinant modular CRISPR DNA construct of any one of embodiments 43-45, and 54-56 wherein at least one of said distinct cTAGs comprises at least two validated CRISPR landing sites.

58. The recombinant modular CRISPR DNA construct of embodiment embodiments 43-45, and 54-57, wherein at least one of the CRISPR landing sites is for a Cas9 endonuclease.

59. The recombinant modular CRISPR DNA construct of any one of embodiments 43-45, and 54-58, wherein at least one of the CRISPR landing sites is for a Cpf1 endonuclease.

60. The recombinant modular CRISPR DNA construct of any one of embodiments 43-45, and 54-59 wherein at least one of said distinct cTAGs comprises a rare (≥8 bases long) restriction endonuclease site.

61. The host cell of any one of embodiments 47-53.2 wherein the catalytically inactivated CRISPR enzyme is a mutated Cas9 endonuclease.

62. The host cell of any one of embodiments 48-53.2, wherein the catalytically inactivated CRISPR enzyme is a mutated Cpf1 endonuclease.

63. The host cell of any one of embodiments 47-53.2, and 61-62 wherein the host cell comprises more than one nucleic acid guide RNA.

64. The host cell of embodiment 63, wherein at least one of the guide RNAs comprises a different sequence than another guide RNA.

65. The host cell of embodiment 64, wherein at least one of the guide RNAs targets a different DNA target site sequence than another guide RNA.

66. The host cell of any one of embodiments 48-53.2, and 61-65 wherein the host cell comprises more than one catalytically inactivated CRISPR enzyme.

67. The host cell of embodiment 66, wherein at least one of the catalytically inactivated CRISPR enzymes comprises a different sequence than another catalytically inactivated CRISPR enzyme encoded in the construct.

68. The insert parts of any one of embodiments 43-67, wherein one or more of the cTAGs is selected from the group consisting of SEQ ID NO: 65-74, 78-81, and combinations thereof.

69. A high throughput method of modulating the expression of one or more host cell genes, said method comprising the step of introducing the recombinant modular CRISPR DNA construct of any one of embodiments 43-45 and 54-60 into a host cell; wherein a DNA target site of a guide RNA is located within the host cell genome.

70. The high throughput method of embodiment 69, wherein at least one insert part of the recombinant modular CRISPR DNA construct is integrated into the genome of the host cell.

71. The high throughput method of embodiment 69 or 70, wherein the insert part regulates the function of a CRISPR protein.

72. The high throughput method of embodiment 69 or 70, wherein the insert part regulates the function of a gRNA.

73. The high throughput method of embodiment 69 or 70, wherein the recombinant modular CRISPR DNA construct remains in the host cell as extra chromosomal DNA.

74. A recombinant modular CRISPR DNA construct for screening CRISPR enzyme variants, said construct comprising a CRISPR multi-clonal site, said multi-clonal site comprising:

a) at least two distinct cloning tags (cTAGs), wherein each cTAG comprises:

i) one or more validated CRISPR landing sites, each comprising a protospacer sequence operably linked to a protospacer adjacent motif (PAM); wherein at least one of said validated CRISPR landing sites is unique within the modular CRISPR DNA construct; and b) one or more DNA insert part(s);

i) wherein each of said distinct cTAGs are distributed in flanking positions around each of the one or more DNA insert part(s);

wherein the construct further comprises:

c) a first nucleic acid encoding a CRISPR enzyme, or an enzyme suspected of having CRISPR functionality ("putative CRISPR enzyme"); and d) a second nucleic acid encoding a guide RNA capable of binding to a DNA target site.

75. A high throughput method of screening CRISPR activity in a host cell, said method comprising the steps of:

a) introducing the recombinant modular CRISPR DNA construct of any one of embodiments 43-45, 54-60 and 74 into the host cell; wherein the DNA target site of a guide RNA is located within the host cell genome; and b) measuring the degree of DNA cleavage occurring at the DNA target site.

76. A high throughput method of screening CRISPRi activity in a host cell, said method comprising the steps of:

a) introducing the recombinant modular CRISPR DNA construct of any one of embodiments 43-45, 54-60 and 74 into the host cell; wherein the DNA target site of a guide RNA is located within the host cell genome; and b) measuring the degree of transcriptional modulation occurring at the DNA target site.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not, be taken as an acknowledgment or any form of suggestion that they constitute valid prior art or form part of the common general knowledge in any country in the world. This application incorporates by reference PCT/US2018/017573 in its entirety for all purposes.

SEQUENCE LISTING (128 sequences)

SEQ ID NO: 1 - protein, 984 aa, Campylobacter jejuni
  MISC_FEATURE (1)..(984): Cas9
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 2 - protein, 1056 aa, Pasteurella multocida
  MISC_FEATURE (1)..(1056): Cas9
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 3 - protein, 1368 aa, Streptococcus pyogenes [sequence omitted]

SEQ ID NO: 4 - protein, 1121 aa, Streptococcus thermophilus
  MISC_FEATURE (1)..(1121): Cas9
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 5 - protein, 1082 aa, Neisseria meningitides
  MISC_FEATURE (1)..(1082): Cas9
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 6 - protein, 1345 aa, Streptococcus mutans
  MISC_FEATURE (1)..(1345): Cas9
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 7 - protein, 1345 aa, Francisella tularensis subsp. Novicida U112
  MISC_FEATURE (1)..(1345): FnCpf1; pY004
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNKRPAATKKAGQAKKKKGSYPYDVPDYAYPYDVPDYAYPYDVPDYA

SEQ ID NO: 8 - protein, 1278 aa, Lachnospiraceae bacterium MC2017
  MISC_FEATURE (1)..(1278): Lb3Cpf1; pY005
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLINKRPAATKKAGQAKKKKGSYPYDVPDYAYPYDVPDYAYPYDVPDYA

SEQ ID NO: 9 - protein, 1345 aa, Butyrivibrio proteoclasticus; identical to SEQ ID NO: 7
  MISC_FEATURE (1)..(1345): BpCpf1; pY006

SEQ ID NO: 10 - protein, 1522 aa, Peregrinibacteria bacterium GW2011_GWA_33_10
  MISC_FEATURE (1)..(1522): PeCpf1; pY007
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEDKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAIMKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTEIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDCWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKKAGQAKKKKGSYPYDVPDYAYPYDVPDYAYPYDVPDYA

SEQ ID NO: 11 - protein, 1397 aa, Parcubacteria bacterium GWC2011_GWC2_44_17
  MISC_FEATURE (1)..(1397): PbCpf1; pY008
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDHKRPAATKKAGQAKKKKGSYPYDVPDYAYPYDVPDYAYPYDVPDYA

SEQ ID NO: 12 - protein, 1295 aa, Smithella sp. SC_K08D17
  MISC_FEATURE (1)..(1295): SsCpf1; pY009
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYAWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKGKRPAATKKAGQAKKKKGSYPYDVPDYAYPYDVPDYAYPYDVPDYA

SEQ ID NO: 13 - protein, 1352 aa, Acidaminococcus sp. BV3L6
  MISC_FEATURE (1)..(1352): AsCpf1; pY010
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKGSYPYDVPDYAYPYDVPDYAYPYDVPDYA

SEQ ID NO: 14 - protein, 1251 aa, Lachnospiraceae bacterium MA2020
  MISC_FEATURE (1)..(1251): Lb2Cpf1; pY011
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLLKRPAATKKAGQAKKKKGSYPYDVPDYAYPYDVPDYAYPYDVPDYA

SEQ ID NO: 15 - protein, 1283 aa, Candidatus Methanoplasma termitum
  MISC_FEATURE (1)..(1283): CMtCpf1; pY012
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGDKRPAATKKAGQAKKKKGSYPYDVPDYAYPYDVPDYAYPYDVPDYA

SEQ ID NO: 16 - protein, 1327 aa, Eubacterium eligens
  MISC_FEATURE (1)..(1327): EeCpf1; pY013
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYEKRPAATKKAGQAKKKKGSYPYDVPDYAYPYDVPDYAYPYDVPDYA

SEQ ID NO: 17 - protein, 1418 aa, Moraxella bovoculi 237
  MISC_FEATURE (1)..(1418): MbCpf1; pY014
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNRKRPAATKKAGQAKKKKGSYPYDVPDYAYPYDVPDYAYPYDVPDYA

SEQ ID NO: 18 - protein, 1308 aa, Leptospira inadai
  MISC_FEATURE (1)..(1308): LiCpf1; pY015
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNRKRPAATKKAGQAKKKKGSYPYDVPDYAYPYDVPDYAYPYDVPDYA

SEQ ID NO: 19 - protein, 1272 aa, Lachnospiraceae bacterium ND2006
  MISC_FEATURE (1)..(1272): LbCpf1; pY016
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHKRPAATKKAGQAKKKKGSYPYDVPDYAYPYDVPDYAYPYDVPDYA

SEQ ID NO: 20 - protein, 1305 aa, Porphyromonas crevioricanis
  MISC_FEATURE (1)..(1305): PcCpf1; pY017
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKDKRPAATKKAGQAKKKKGSYPYDVPDYAYPYDVPDYAYPYDVPDYA

SEQ ID NO: 21 - protein, 1368 aa, Prevotella disiens
  MISC_FEATURE (1)..(1368): PdCpf1; pY018
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLKKRPAATKKAGQAKKKKGSYPYDVPDYAYPYDVPDYAYPYDVPDYA

SEQ ID NO: 22 - protein, 1291 aa, Porphyromonas macacae
  MISC_FEATURE (1)..(1291): PmCpf1; pY09
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVEKRPAATKKAGQAKKKKGSYPYDVPDYAYPYDVPDYAYPYDVPDYA

SEQ ID NO: 23 - protein, 399 aa, Francisella philomiragia subsp.
  MISC_FEATURE (1)..(399): Genbank ABZ87876 Cpf1
MFYLKQILSDTESKSFVIDKLEDDSDVVTTIQSFYEQIAAFKTLEEKSIKETLSLLFDDLKAQKLDLSKIYFKNDKSLTDLSQQVFDDYSLIGTSVLEYITQQVAPKNLDNPSKKEQELIAKKTEKAKYLSLETIRDALNEFNKHRDIDKQCRFEEIFASFADIPVLFDEIAQNKNNLAQISIKYQNQGKKDLLQTSAEVDVKAIKDLLDQTNNLLHKLKIFHITQSEDKANILDKDEHFYLVFDECYFELANIVPLYNKIRNYITQKPYSDEKFKLNFENSTLANGWDKNKEPDNTAILFIKDDKYYLGVMNKKNNKIFDDKAIKENKGEGYKKVVYKLLPGANKMLPKVFFSAKSINFYNPSEDILRIRNHSTHTKNGSPQKDMKNLSLILKIAENL

SEQ ID NO: 24 - protein, 485 aa, Francisella philomiragia subsp.
  MISC_FEATURE (1)..(485): Genbank ABZ87877 Cpf1
MVYKLNGEAELFYRKQSIPKKITHPAKQAIANKNKDNPKKESFFEYDLIKDKRFTEDKFFFHCPITMNFKSSGANKFNDEVNLLLKEKANDVHILSIDRGERHLAYYTLVDSKGNIIKQDTFNIIGNDRMKTNYHDKLAAIEKDRESARKDWKKINNIKEMKEGYLSQVVHEIAKLVIEYNAIVVFEDLNFGFKRGRFKVEKQVYQKLEKMLIEKLNYLVFKDNEFDKAGGVLRAYQLTAPFETFKKMGKQTGVIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSILNSILQMRNSKTGTELDYLISPVADVNGNFFDSRHAPKNMPQDADANGAYHIGLKGLMLLYRIKNNQDGKKLNLVIKNEEYFEFVQNRNKSSKI

SEQ ID NO: 25 - protein, 939 aa, Francisella philomiragia subsp.
  MISC_FEATURE (1)..(939): Genbank AJI56734 Cpf1
MNLYSNLTNKYSLSKTLRFELIPQGETLENIKARGLILDDEKRAKDYKKAKQIIDKYHQFFIEEILSSVCISEDLLQNYSDVYFKLKKSDDDNLQKDFKSAKDTIKKHISRYINDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFIENKAKYENLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTLEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKYRDIDKQCRFEEIFASFADIPVLFDEIAQNKNNLAQISIKYQNQGKKDLLQTSAEVDVKAIKDLLDQTNNLLHKLKIFHITQSEDKANILDKDEHFYLVFDECYFELANIVALYNKIRNYITQKPYSDEKFKLNFENSTLANGWDKNKEPDNTAILFIKDDKYYLGVMNKKNNKIFDDKAIKENKGEGYKKVVYKLLPGANKMLPKVFFSAKSINFYNPSEDILRIRNHSTHTKNGSPQKGYEKLEFNIEDCRKFIDFYKHSISRHPEWKDFGFRFSDTKKYNSIDEFYREVENQGYKLTFENISESYIDSLVDEGKLYLFQIYNKDFSVYSKGKPNLHTLYWKALFDERNLQDVVYKLNGEAELFYRKQSIPKKITHPAKEAIANKNKDNPKKESIFEYDLIKDKRFTEDKFFFHCPITINFKSSGANKFNDEINLLLKEKANDVHILSIDRGERHLAYYTLVDGKGNIICKN

SEQ ID NO: 26 - protein, 1261 aa, Moraxella bovoculi
  MISC_FEATURE (1)..(1261): Genbank AKG08867 Cpf1
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPKVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 27 - protein, 1282 aa, Eubacterium eligens
  MISC_FEATURE (1)..(1282): Genbank CDA41776 Cpf1
MNGNRSIVYREFVGVTPVAKTLRNELRPVGHTQEHIIQNGLIQEDELRQEKSTELKNIMDDYYREYIDKSLSGLTDLDFTLLFELMNSVQSSLSKDNKKALEKEHNKMREQICTHLQSDSDYKNMFNAKLFKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDEHISLIESEEKADEIKKRLDMYMNMYHWVKAFIVDEVLDRDEMFYSDIDDIYNILENIVPLYNRVRNYVTQKPYTSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKDFAENSTGKENLHTMYFKNIFSEENLKNIVIKLNGQAELFYRKASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDVRIDMEKMYEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 28 - protein, 1263 aa, Eubacterium rectale
  MISC_FEATURE (1)..(1263): Genbank CUM80100 Cpf1
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQAEKRKAIYKKFADDDRFKNMFSAKLISDILPEFVIHNNNYSASEKEEKTQVIKLFSRFATSFKDYFKNRANCFSADDISSSSCHRIVNDNAEIFFSNALVYRRIVKNLSNDDINKISGDMKDSLKEMSLDEIYSYEKYGEFITQEGISFYNDICGKVNSFMNLYCQKNKENKNLYKLRKLHKQILCIADTSYEVPYKFESDEEVYQSVNGFLDNISSKHIVERLRKIGDNYNGYNLDKIYIVSRFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCRDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKENDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPEKLKNVGHQCGCIFYVPAAYTSKIDPTTGFANIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 29 - protein, 966 aa, Unknown
  Uncultured Bacterium (groundwater metagenome) hypothetical protein ACD_18C00234G0001
  MISC_FEATURE (1)..(966): Genbank EKE06926 Cpf1
MENYDKCLTQLGIEKFNLEIVGEINKELNLFSQQNRDILPKAPKLKFLYKQIGCGKRIFDLFSIIVGNEWKELKNLQNNKDDGKSFSQKELLEKIRKLYKLFFDKPSDYELDKIYFNKQSINTISSMWFVNWHKLSELLSGKRIIKNKNKETGEYTIPKKISLADLKNILESETNVEDLFKKGKINEDEIKENNSVGVYEKLFSSNGWETFLAIWEYEINESFKVLDNNVAKFELKKQTKFQNLDKKERVFFIKEFCDAFLAIERMVKYHKVDENNDTDDNFYETIDLYLQETELRKYYDAFRNYLTEKPFSENKIKLNFKSGTLLGGWSQTFETYGSLIFEKNGEYFLGIINGTKFSESELNKIYNINSDSIKAKRLLYNTQKIDNKNPPRWFIRSKKTTFSPMVREGLLDPESILELYDKKLYSKTENKNGYKEYLPRLLDYFKDGFLKHKDFVQFKENFKWLDNSEYDTVVDFYNHTADMCYKTSWEDINFTELENLTKDSRIYLFKIYNKDFAEKTSGIKNSHTILFLELLKSENNLKLKLLGGGEVFYREKSIEKEIDKERSFKTDKFEIIKNKRYSEEKYFLHFPIEIKGRKLKGSFNQFLNKEISKKESVNILGIDRGEKHLLYYSLVNNNGEIIKQGSFNKIKCGNKIVDYNELLSKRAKEMMEARQSWETIGKIKDLKEGYLSQVIHEIYKLVIENNAIVVLEDLNTEFKAKRTAKVEKSVYKKFELALVKKLNHLILKEKKANELGGSLNAYQLTPYIKPGDVDKFEKAKQWGIMFYVRPDYTSQTDPVTGWRKTIYISNSETIENIKKKWKDANIKIYFDSDKKCFKFLYDKWELCAYPNLERLYWNRSEKNAEGKFGNMKKYSLHKEFECIFEGVNKSKNISDQMFDKEDFNWKSFIFYWNLLNQIRNSDKSKDENESDFIQSPIWSEKINDFFDSRKKYQIDLPENGDANGAY

SEQ ID NO: 30 - protein, 1247 aa, Unknown
  Uncultured bacterium (gcode 4) (groundwater metagenome) hypothetical protein ACD_3C00058G0015
  MISC_FEATURE (1)..(1247): Genbank EKE28449 Cpf1
MFKGDAFTGLYEVQKTLRFELVPIGLTQSYLENDWVIQKDKEVEENYGKIKAYFDLIHKEFVRQSLENAWLCQLDDFYEKYIELHNSLETRKDKNLAKQFEKVMKSLKKEFVSFFDAKWNEWKQKFSFLKKWWIDVLNEKEVLDLMAEFYPDEKELFDKFDKFFTYFSNFKESRKNFYADDGRAWAIATRAIDENLITFIKNIEDFKKLNSSFREFVNDNFSEEDKQIFEIDFYNNCLLQPWIDKYNKIVWWYSLENWEKVQWLNEKINNFKQNQNKSNSKDLKFPRMKLLYKQILGDKEKKVYIDEIRDDKNLIDLIDNSKRRNQIKIDNANDIINDFINNNAKFELDKIYLTRQSINTISSKYFSSWDYIRWYFWTGELQEFVSFYDLKETFWKIEYETLENIFKDCYVKGINTESQNNIVFETQGIYENFLNIFKFEFNQNISQISLLEWELDKIQNEDIKKNEKQVEVIKNYFDSVMSVYKMTKYFSLEKWKKRVELDTDNNFYNDFNEYLEGFEIWKDYNLVRNYITKKQVNTDKIKLNFDNSQFLTWWDKDKENERLGIILRREWKYYLWILKKWNTLNFGDYLQKEWEIFYEKMNYKQLNNVYRQLPRLLFPLTKKLNELKWDELKKYLSKYIQNFWYNEEIAQIKIEFDIFQESKEKWEKFDIDKLRKLIEYYKKWVLALYSDLYDLEFIKYKNYDDLSIFYSDVEKKMYNLNFTKIDKSLIDGKVKSWELYLFQIYNKDFSESKKEWSTENIHTKYFKLLFNEKNLQNLVVKLSWWADIFFRDKTENLKFKKDKNGQEILDHRRFSQDKIMFHISITLNANCWDKYWFNQYVNEYMNKERDIKIIWIDRWEKHLAYYCVIDKSWKIFNNEIWTLNELNWVNYLEKLEKIESSRKDSRISWWEIENIKELKNGYISQVINKLTELIVKYNAIIVFEDLNIWFKRWRQKIEKQIYQKLELALAKKLNYLTQKDKKDDEILWNLKALQLVPKVNDYQDIWNYKQSWIMFYVRANYTSVTCPNCWLRKNLYISNSATKENQKKSLNSIAIKYNDWKFSFSYEIDDKSWKQKQSLNKKKFIVYSDIERFVYSPLEKLTKVIDVNKKLLELFRDFNLSLDINKQIQEKDLDSVFFKSLTHLFNLILQLRNSDSKDNKDYISCPSCYYHSNNWLQWFEFNWDANWAYNIARKGIILLDRIRKNQEKPDLYVSDIDWDNFVQSNQFPNTIIPIQNIEKQVPLNIKI

SEQ ID NO: 31 - protein, 1250 aa, Smithella sp.
  MISC_FEATURE (1)..(1250): Genbank KFO67989 Cpf1
MQTLFENFTNQYPVSKTLRFELIPQGKTKDFIEQKGLLKKDEDRAEKYKKVKNIIDEYHKDFIEKSLNGLKLDGLEEYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKIYFRSGTSLTDVSRKVFGEWSIINRALDNYYATTYPIKPREKSEKYEERKEKWLKQDFNVSLIQTAIDEYDNETVKGKNSGKVIVDYFAKFCDDKETDLIQKVNEGYIAVKDLLNTPYPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKENLYYLGIMDKRHNRIFRNVPKADKKDSCYEKMVYKLLPGANKMLPKVFFSQSRIQEFTPSAKLLENYENETHKKGDNFNLNHCHQLIDFFKDSINKHEDWKNFDFRFSATSTYADLSGFYHEVEHQGYKISFQSIADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHVPITMNFKAEGIFNMNQRVNQFLKANPDINIIGIDRGERHLLYYTLINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLKQAKDFFEKFDSIRLNSKADYFEFAFDFKNFTGKADGGRTKWTVCTTNEDRYAWNRALNNNRGSQEKYDITAELKSLFDGKVDYKSGKDLKQQIASQELADFFRTLMKYLSVTLSLRHNNGEKGETEQDYILSPVADSMGKFFDSRKAGDDMPKNADANGAYHIALKGLWCLEQISKTDDLKKVKLAISNKEWLEFMQTLKG

SEQ ID NO: 32 - protein, 1477 aa, Candidatus Peregrinibacteria
  MISC_FEATURE (1)..(1477): Genbank KKP36646 Cpf1
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEDKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAIMKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTEIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDCWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKK

SEQ ID NO: 33 - protein, 1285 aa, Candidatus Roizmanbacteria bacterium
  MISC_FEATURE (1)..(1285): Genbank KKQ38174 Cpf1
MKSFDSFTNLYSLSKTLKFEMRPVGNTQKMLDNAGVFEKDKLIQKKYGKTKPYFDRLHREFIEEALTGVELIGLDENFRTLVDWQKDKKNNVAMKAYENSLQRLRTEIGKIFNLKAEDWVKNKYPILGLKNKNTDILFEEAVFGILKARYGEEKDTFIEVEEIDKTGKSKINQISIFDSWKGFTGYFKKFFETRKNFYKNDGTSTAIATRIIDQNLKRFIDNLSIVESVRQKVDLAETEKSFSISLSQFFSIDFYNKCLLQDGIDYYNKIIGGETLKNGEKLIGLNELINQYRQNNKDQKIPFFKLLDKQILSEKILFLDEIKNDTELIEALSQFAKTAEEKTKIVKKLFADFVENNSKYDLAQIYISQEAFNTISNKWTSETETFAKYLFEAMKSGKLAKYEKKDNSYKFPDFIALSQMKSALLSISLEGHFWKEKYYKISKFQEKTNWEQFLAIFLYEFNSLFSDKINTKDGETKQVGYYLFAKDLHNLILSEQIDIPKDSKVTIKDFADSVLTIYQMAKYFAVEKKRAWLAEYELDSFYTQPDTGYLQFYDNAYEDIVQVYNKLRNYLTKKPYSEEKWKLNFENSTLANGWDKNKESDNSAVILQKGGKYYLGLITKGHNKIFDDRFQEKFIVGIEGGKYEKIVYKFFPDQAKMFPKVCFSAKGLEFFRPSEEILRIYNNAEFKKGETYSIDSMQKLIDFYKDCLTKYEGWACYTFRHLKPTEEYQNNIGEFFRDVAEDGYRIDFQGISDQYIHEKNEKGELHLFEIHNKDWNLDKARDGKSKTTQKNLHTLYFESLFSNDNVVQNFPIKLNGQAEIFYRPKTEKDKLESKKDKKGNKVIDHKRYSENKIFFHVPLTLNRTKNDSYRFNAQINNFLANNKDINIIGVDRGEKHLVYYSVITQASDILESGSLNELNGVNYAEKLGKKAENREQARRDWQDVQGIKDLKKGYISQVVRKLADLAIKHNAIIILEDLNMRFKQVRGGIEKSIYQQLEKALIDKLSFLVDKGEKNPEQAGHLLKAYQLSAPFETFQKMGKQTGIIFYTQASYTSKSDPVTGWRPHLYLKYFSAKKAKDDIAKFTKIEFVNDRFELTYDIKDFQQAKEYPNKTVWKVCSNVERFRWDKNLNQNKGGYTHYTNITENIQELFTKYGIDITKDLLTQISTIDEKQNTSFFRDFIFYFNLICQIRNTDDSEIAKKNGKDDFILSPVEPFFDSRKDNGNKLPENGDDNGAYNIARKGIVILNKISQYSEKNENCEKMKWGDLYVSNIDWDNFVTQANARH

SEQ ID NO: 34 - protein, 1403 aa, Candidatus Falkowbacteria bacterium
  MISC_FEATURE (1)..(1403): Genbank KKR91555 Cpf1
MLFFMSTDITNKPREKGVFDNFTNLYEFSKTLTFGLIPLKWDDNKKMIVEDEDFSVLRKYGVIEEDKRIAESIKIAKFYLNILHRELIGKVLGSLKFEKKNLENYDRLLGEIEKNNKNENISEDKKKEIRKNFKKELSIAQDILLKKVGEVFESNGSGILSSKNCLDELTKRFTRQEVDKLRRENKDIGVEYPDVAYREKDGKEETKSFFAMDVGYLDDFHKNRKQLYSVKGKKNSLGRRILDNFEIFCKNKKLYEKYKNLDIDFSEIERNFNLTLEKVFDFDNYNERLTQEGLDEYAKILGGESNKQERTANIHGLNQIINLYIQKKQSEQKAEQKETGKKKIKFNKKDYPTFTCLQKQILSQVFRKEIIIESDRDLIRELKFFVEESKEKVDKARGIIEFLLNHEENDIDLAMVYLPKSKINSFVYKVFKEPQDFLSVFQDGASNLDFVSFDKIKTHLENNKLTYKIFFKTLIKENHDFESFLILLQQEIDLLIDGGETVTLGGKKESITSLDEKKNRLKEKLGWFEGKVRENEKMKDEEEGEFCSTVLAYSQAVLNITKRAEIFWLNEKQDAKVGEDNKDMIFYKKFDEFADDGFAPFFYFDKFGNYLKRRSRNTTKEIKLHFGNDDLLEGWDMNKEPEYWSFILRDRNQYYLGIGKKDGEIFHKKLGNSVEAVKEAYELENEADFYEKIDYKQLNIDRFEGIAFPKKTKTEEAFRQVCKKRADEFLGGDTYEFKILLAIKKEYDDFKARRQKEKDWDSKFSKEKMSKLIEYYITCLGKRDDWKRFNLNFRQPKEYEDRSDFVRHIQRQAYWIDPRKVSKDYVDKKVAEGEMFLFKVHNKDFYDFERKSEDKKNHTANLFTQYLLELFSCENIKNIKSKDLIESIFELDGKAEIRFRPKTDDVKLKIYQKKGKDVTYADKRDGNKEKEVIQHRRFAKDALTLHLKIRLNFGKHVNLFDFNKLVNTELFAKVPVKILGMDRGENNLIYYCFLDEHGEIENGKCGSLNRVGEQIITLEDDKKVKEPVDYFQLLVDREGQRDWEQKNWQKMTRIKDLKKAYLGNVVSWISKEMLSGIKEGVVTIGVLEDLNSNFKRTRFFRERQVYQGFEKALVNKLGYLVDKKYDNYRNVYQFAPIVDSVEEMEKNKQIGTLVYVPASYTSKICPHPKCGWRERLYMKNSASKEKIVGLLKSDGIKISYDQKNDRFYFEYQWEQEHKSDGKKKKYSGVDKVFSNVSRMRWDVEQKKSIDFVDGTDGSITNKLKSLLKGKGIELDNINQQIVNQQKELGVEFFQSIIFYFNLIMQIRNYDKEKSGSEADYIQCPSCLFDSRKPEMNGKLSAITNGDANGAYNIARKGFMQLCRIRENPQEPMKLITNREWDEAVREWDIYSAAQKIPVLSEEN

SEQ ID NO: 35 - protein, 1352 aa, Parcubacteria group bacterium
  MISC_FEATURE (1)..(1352): Genbank KKT48220 Cpf1
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 36 - protein, 1298 aa, Thiomicrospira sp.
  MISC_FEATURE (1)..(1298): Genbank KUJ74576 Cpf1
MTKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 37 - protein, 1242 aa, Bacteroidales bacterium
  MISC_FEATURE (1)..(1242): Genbank KXB38146 Cpf1
MKKFTNLYPVQKTLRFELIPQGNTSKHLCKIIQEDEQIAEDSQEVKKLLDRYHKEFIAIALSSFPTSPLAKEIIPKLKEFAQIRATGDAKQISTIQDELRELVVKGFKGEGEQERRYKILIGAKGNPNADELFNTELINFLKDPAEQALVKKFQKHTGYFLGFNENRKNMYSAKAQSTAIAYRLIHENLPRFLDNITTYEKVKTYLKEEIPQLEKELVRAGASLVSHVDSVFTIDFFLEVFTQSGIDQYNALIGKIVNQEQGEVKGLNERINLYNQQHKQEAKLPLFKPLYKQILSDREQLSWLAEAYNSDKDLLDSIQKYYQLLIDNQIFERIPRLMHTLEKAPLDKIWITYDTQLTSISNTLYGSWRVIGEALGRNAKSEKERKSSQKKALNYSLESINQAIAKMPSDEELPPIQKYFIALGSNPSKKDASSGTLVDKVRSSYKACQDILTNPDHTGKKLIQDKKQVDLLKQLLDDLLILQRFIKPLLYSNNENETHKDEVFYTELTDIMDLLNPIVGLYNKVRNYLTQKPYSTEKFKINFKSSSLLAGWDRNKEKDNLGVILKREDKYYLAIMDKAHNATFKNKSLPTQGECYEKMEYKLLPGANKMLPKVYITSKKGIESFHPSEELQKKYKLGTHKKGASFNLSDMRALIDYFKESLEKHEEHSQFGFHFSDTSTYEDISGFYREVEQQAYKITFRKVSVEYIDQLVNEGKLYLFQIYNKDFSPYSKGTPNLHTLYWKMLFDPANLQDIVYKLNGEAEVFFRKKSLQYDRPTHPKGQPINKKSLLNEGETSLFDYDLIKDRRFTVDKFQFHVPITMNFKATQGTKVNQMVQEEVKKSKGFHLIGIDRGERNLLYIVVINERGEIIEQCSLNKIVNTYQEKEHTVDYKALLEKRSQSRLEERKSWQTIENIKELKGGYLSQVVHKIAQLMIKYNAIAVLEDLNFGFIRTRKKFEFSVYQEFEKKLIDKLGYVVDKKAPIQQEGGLLQAYQLTAPFKSFREMGKQNGFLFYVPAWNTSAIDPRTGFVNLLDTRYESIAKTKELIKKLKDIRYNSQKDWFEIDLDYNAFGNRAKGSRSKWRLCSYGERIEHTRKQDSNGQEESDSMVVLTEAFKDVFTKYQIDYRENLKEQLLLQSDKAFFVDFLSLLRLTLQLRNSLSNSLIDYILSPVADENGEFFDSRKALSNEPQDADANGAYHIALKGLWVLDKIRKTEKVTPAKLALSNQEWLSFAQEKPFFNE

SEQ ID NO: 38 - protein, 1300 aa, Francisella tularensis
  MISC_FEATURE (1)..(1300): Genbank WP_003040289 Cpf1
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 39 - protein, 1310 aa, Helcococcus kunzii
  MISC_FEATURE (1)..(1310): Genbank WP_005398606 Cpf1
MFEKLSNIVSISKTIRFKLIPVGKTLENIEKLGKLEKDFERSDFYPILKNISDDYYRQYIKEKLSDLNLDWQKLYDAHELLDSSKKESQKNLEMIQAQYRKVLFNILSGELDKSGEKNSKDLIKNNKALYGKLFKKQFILEVLPDFVNNNDSYSEEDLEGLNLYSKFTTRLKNFWETRKNVFTDKDIVTAIPFRAVNENFGFYYDNIKIFNKNIEYLENKIPNLENELKEADILDDNRSVKDYFTPNGFNYVITQDGIDVYQAIRGGFTKENGEKVQGINEILNLTQQQLRRKPETKNVKLGVLTKLRKQILEYSESTSFLIDQIEDDNDLVDRINKFNVSFFESTEVSPSLFEQIERLYNALKSIKKEEVYIDARNTQKFSQMLFGQWDVIRRGYTVKITEGSKEEKKKYKEYLELDETSKAKRYLNIREIEELVNLVEGFEEVDVFSVLLEKFKMNNIERSEFEAPIYGSPIKLEAIKEYLEKHLEEYHKWKLLLIGNDDLDTDETFYPLLNEVISDYYIIPLYNLTRNYLTRKHSDKDKIKVNFDFPTLADGWSESKISDNRSIILRKGGYYYLGILIDNKLLINKKNKSKKIYEILIYNQIPEFSKSIPNYPFTKKVKEHFKNNVSDFQLIDGYVSPLIITKEIYDIKKEKKYKKDFYKDNNTNKNYLYTIYKWIEFCKQFLYKYKGPNKESYKEMYDFSTLKDTSLYVNLNDFYADVNSCAYRVLFNKIDENTIDNAVEDGKLLLFQIYNKDFSPESKGKKNLHTLYWLSMFSEENLRTRKLKLNGQAEIFYRKKLEKKPIIHKEGSILLNKIDKEGNTIPENIYHECYRYLNKKIGREDLSDEAIALFNKDVLKYKEARFDIIKDRRYSESQFFFHVPITFNWDIKTNKNVNQIVQGMIKDGEIKHIIGIDRGERHLLYYSVIDLEGNIVEQGSLNTLEQNRFDNSTVKVDYQNKLRTREEDRDRARKNWTNINKIKELKDGYLSHVVHKLSRLIIKYEAIVIMENLNQGFKRGRFKVERQVYQKFELALMNKLSALSFKEKYDERKNLEPSGILNPIQACYPVDAYQELQGQNGIVFYLPAAYTSVIDPVTGFTNLFRLKSINSSKYEEFIKKFKNIYFDNEEEDFKFIFNYKDFAKANLVILNNIKSKDWKISTRGERISYNSKKKEYFYVQPTEFLINKLKELNIDYENIDIIPLIDNLEEKAKRKILKALFDTFKYSVQLRNYDFENDYIISPTADDNGNYYNSNEIDIDKTNLPNNGDANGAFNIARKGLLLKDRIVNSNESKVDLKIKNEDWINFIIS

SEQ ID NO: 40 - protein, 1257 aa, Prevotella bryantii
  MISC_FEATURE (1)..(1257): Genbank WP_006283774 Cpf1
MQINNLKIIYMKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 41 - protein, 1262 aa, Bacteroidetes oral
  MISC_FEATURE (1)..(1262): Genbank WP_009217842 Cpf1
MRKFNEFVGLYPISKTLRFELKPIGKTLEHIQRNKLLEHDAVRADDYVKVKKIIDKYHKCLIDEALSGFTFDTEADGRSNNSLSEYYLYYNLKKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVVSSPLAEKINALYEDFKEYLNVEEISRVFRLDYYDELLTQKQIDLYNAIVGGRTEEDNKIQIKGLNQYINEYNQQQTDRSNRLPKLKPLYKQILSDRESVSWLPPKFDSDKNLLIKIKECYDALSEKEKVFDKLESILKSLSTYDLSKIYISNDSQLSYISQKMFGRWDIISKAIREDCAKRNPQKSRESLEKFAERIDKKLKTIDSISIGDVDECLAQLGETYVKRVEDYFVAMGESEIDDEQTDTTSFKKNIEGAYESVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFLPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKVFFDKFKSIRYNSDKDWFEFVVDDYTRFSPKAEGTRRDWTICTQGKRIQICRNHQRNNEWEGQEIDLTKAFKEHFEAYGVDISKDLREQINTQNKKEFFEELLRLLRLTLQMRNSMPSSDIDYLISPVANDTGCFFDSRKQAELKENAVLPMNADANGAYNIARKGLLAIRKMKQEENDSAKISLAISNKEWLKFAQTKPYLED

SEQ ID NO: 42 - protein, 1318 aa, Flavobacterium branchiophilum
  MISC_FEATURE (1)..(1318): Genbank WP_014085038 Cpf1
MTNKFTNQYSLSKTLRFELIPQGKTLEFIQEKGLLSQDKQRAESYQEMKKTIDKFHKYFIDLALSNAKLTHLETYLELYNKSAETKKEQKFKDDLKKVQDNLRKEIVKSFSDGDAKSIFAILDKKELITVELEKWFENNEQKDIYFDEKFKTFTTYFTGFHQNRKNMYSVEPNSTAIAYRLIHENLPKFLENAKAFEKIKQVESLQVNFRELMGEFGDEGLIFVNELEEMFQINYYNDVLSQNGITIYNSIISGFTKNDIKYKGLNEYINNYNQTKDKKDRLPKLKQLYKQILSDRISLSFLPDAFTDGKQVLKAIFDFYKINLLSYTIEGQEESQNLLLLIRQTIENLSSFDTQKIYLKNDTHLTTISQQVFGDFSVFSTALNYWYETKVNPKFETEYSKANEKKREILDKAKAVFTKQDYFSIAFLQEVLSEYILTLDHTSDIVKKHSSNCIADYFKNHFVAKKENETDKTFDFIANITAKYQCIQGILENADQYEDELKQDQKLIDNLKFFLDAILELLHFIKPLHLKSESITEKDTAFYDVFENYYEALSLLTPLYNMVRNYVTQKPYSTEKIKLNFENAQLLNGWDANKEGDYLTTILKKDGNYFLAIMDKKHNKAFQKFPEGKENYEKMVYKLLPGVNKMLPKVFFSNKNIAYFNPSKELLENYKKETHKKGDTFNLEHCHTLIDFFKDSLNKHEDWKYFDFQFSETKSYQDLSGFYREVEHQGYKINFKNIDSEYIDGLVNEGKLFLFQIYSKDFSPFSKGKPNMHTLYWKALFEEQNLQNVIYKLNGQAEIFFRKASIKPKNIILHKKKIKIAKKHFIDKKTKTSEIVPVQTIKNLNMYYQGKISEKELTQDDLRYIDNFSIFNEKNKTIDIIKDKRFTVDKFQFHVPITMNFKATGGSYINQTVLEYLQNNPEVKIIGLDRGERHLVYLTLIDQQGNILKQESLNTITDSKISTPYHKLLDNKENERDLARKNWGTVENIKELKEGYISQVVHKIATLMLEENAIVVMEDLNFGFKRGRFKVEKQIYQKLEKMLIDKLNYLVLKDKQPQELGGLYNALQLTNKFESFQKMGKQSGFLFYVPAWNTSKIDPTTGFVNYFYTKYENVDKAKAFFEKFEAIRFNAEKKYFEFEVKKYSDFNPKAEGTQQAWTICTYGERIETKRQKDQNNKFVSTPINLTEKIEDFLGKNQIVYGDGNCIKSQIASKDDKAFFETLLYWFKMTLQMRNSETRTDIDYLISPVMNDNGTFYNSRDYEKLENPTLPKDADANGAYHIAKKGLMLLNKIDQADLTKKVDLSISNRDWLQFVQKNK

SEQ ID NO: 43 - protein, 1230 aa, Lachnospiraceae bacterium
  MISC_FEATURE (1)..(1230): Genbank WP_016301126 Cpf1
MHENNGKIADNFIGIYPVSKTLRFELKPVGKTQEYIEKHGILDEDLKRAGDYKSVKKIIDAYHKYFIDEALNGIQLDGLKNYYELYEKKRDNNEEKEFQKIQMSLRKQIVKRFSEHPQYKYLFKKELIKNVLPEFTKDNAEEQTLVKSFQEFTTYFEGFHQNRKNMYSDEEKSTAIAYRVVHQNLPKYIDNMRIFSMILNTDIRSDLTELFNNLKTKMDITIVEEYFAIDGFNKVVNQKGIDVYNTILGAFSTDDNTKIKGLNEYINLYNQKNKAKLPKLKPLFKQILSDRDKISFIPEQFDSDTEVLEAVDMFYNRLLQFVIENEGQITISKLLTNFSAYDLNKIYVKNDTTISAISNDLFDDWSYISKAVRENYDSENVDKNKRAAAYEEKKEKALSKIKMYSIEELNFFVKKYSCNECHIEGYFERRILEILDKMRYAYESCKILHDKGLINNISLCQDRQAISELKDFLDSIKEVQWLLKPLMIGQEQADKEEAFYTELLRIWEELEPITLLYNKVRNYVTKKPYTLEKVKLNFYKSTLLDGWDKNKEKDNLGIILLKDGQYYLGIMNRRNNKIADDAPLAKTDNVYRKMEYKLLTKVSANLPRIFLKDKYNPSEEMLEKYEKGTHLKGENFCIDDCRELIDFFKKGIKQYEDWGQFDFKFSDTESYDDISAFYKEVEHQGYKITFRDIDETYIDSLVNEGKLYLFQIYNKDFSPYSKGTKNLHTLYWEMLFSQQNLQNIVYKLNGNAEIFYRKASINQKDVVVHKADLPIKNKDPQNSKKESMFDYDIIKDKRFTCDKYQFHVPITMNFKALGENHFNRKVNRLIHDAENMHIIGIDRGERNLIYLCMIDMKGNIVKQISLNEIISYDKNKLEHKRNYHQLLKTREDENKSARQSWQTIHTIKELKEGYLSQVIHVITDLMVEYNAIVVLEDLNFGFKQGRQKFERQVYQKFEKMLIDKLNYLVDKSKGMDEDGGLLHAYQLTDEFKSFKQLGKQSGFLYYIPAWNTSKLDPTTGFVNLFYTKYESVEKSKEFINNFTSILYNQEREYFEFLFDYSAFTSKAEGSRLKWTVCSKGERVETYRNPKKNNEWDTQKIDLTFELKKLFNDYSISLLDGDLREQMGKIDKADFYKKFMKLFALIVQMRNSDEREDKLISPVLNKYGAFFETGKNERMPLDADANGAYNIARKGLWIIEKIKNTDVEQLDKVKLTISNKEWLQYAQEHIL

SEQ ID NO: 44 - protein, 1246 aa, Porphyromonas macacae
  MISC_FEATURE (1)..(1246): Genbank WP_018359861 Cpf1
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 45 - protein, 1259 aa, Synergistes jonesii
  MISC_FEATURE (1)..(1259): Genbank WP_037975888 Type V CV CRISPR-associated protein Cpf1
MANSLKDFTNIYQLSKTLRFELKPIGKTEEHINRKLIIMHDEKRGEDYKSVTKLIDDYHRKFIHETLDPAHFDWNPLAEALIQSGSKNNKALPAEQKEMREKIISMFTSQAVYKKLFKKELFSELLPEMIKSELVSDLEKQAQLDAVKSFDKFSTYFTGFHENRKNIYSKKDTSTSIAFRIVHQNFPKFLANVRAYTLIKERAPEVIDKAQKELSGILGGKTLDDIFSIESFNNVLTQDKIDYYNQIIGGVSGKAGDKKLRGVNEFSNLYRQQHPEVASLRIKMVPLYKQILSDRTTLSFVPEALKDDEQAINAVDGLRSELERNDIFNRIKRLFGKNNLYSLDKIWIKNSSISAFSNELFKNWSFIEDALKEFKENEFNGARSAGKKAEKWLKSKYFSFADIDAAVKSYSEQVSADISSAPSASYFAKFTNLIETAAENGRKFSYFAAESKAFRGDDGKTEIIKAYLDSLNDILHCLKPFETEDISDIDTEFYSAFAEIYDSVKDVIPVYNAVRNYTTQKPFSTEKFKLNFENPALAKGWDKNKEQNNTAIILMKDGKYYLGVIDKNNKLRADDLADDGSAYGYMKMNYKFIPTPHMELPKVFLPKRAPKRYNPSREILLIKENKTFIKDKNFNRTDCHKLIDFFKDSINKHKDWRTFGFDFSDTDSYEDISDFYMEVQDQGYKLTFTRLSAEKIDKWVEEGRLFLFQIYNKDFADGAQGSPNLHTLYWKAIFSEENLKDVVLKLNGEAELFFRRKSIDKPAVHAKGSMKVNRRDIDGNPIDEGTYVEICGYANGKRDMASLNAGARGLIESGLVRITEVKHELVKDKRYTIDKYFFHVPFTINFKAQGQGNINSDVNLFLRNNKDVNIIGIDRGERNLVYVSLIDRDGHIKLQKDFNIIGGMDYHAKLNQKEKERDTARKSWKTIGTIKELKEGYLSQVVHEIVRLAVDNNAVIVMEDLNIGFKRGRFKVEKQVYQKFEKMLIDKLNYLVFKDAGYDAPCGILKGLQLTEKFESFTKLGKQCGIIFYIPAGYTSKIDPTTGFVNLFNINDVSSKEKQKDFIGKLDSIRFDAKRDMFTFEFDYDKFRTYQTSYRKKWAVWTNGKRIVREKDKDGKFRMNDRLLTEDMKNILNKYALAYKAGEDILPDVISRDKSLASEIFYVFKNTLQMRNSKRDTGEDFIISPVLNAKGRFFDSRKTDAALPIDADANGAYHIALKGSLVLDAIDEKLKEDGRIDYKDMAVSNPKWFEFMQTRKFDF

SEQ ID NO: 46 - protein, 1263 aa, Leptospira inadai
  MISC_FEATURE (1)..(1263): Genbank WP_020988726 Cpf1
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 47 - protein, 1260 aa, Porphyromonas crevioricanis
  MISC_FEATURE (1)..(1260): Genbank WP_023941260 Cpf1
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKVLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQERRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHAQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 48 - protein, 1253 aa, Prevotella albensis
  MISC_FEATURE (1)..(1253): Genbank WP_024988992 Cpf1
MNIKNFTGLYPLSKTLRFELKPIGKTKENIEKNGILTKDEQRAKDYLIVKGFIDEYHKQFIKDRLWDFKLPLESEGEKNSLEEYQELYELTKRNDAQEADFTEIKDNLRSSITEQLTKSGSAYDRIFKKEFIREDLVNFLEDEKDKNIVKQFEDFTTYFTGFYENRKNMYSSEEKSTAIAYRLIHQNLPKFMDNMRSFAKIANSSVSEHFSDIYESWKEYLNVNSIEEIFQLDYFSETLTQPHIEVYNYIIGKKVLEDGTEIKGINEYVNLYNQQQKDKSKRLPFLVPLYKQILSDREKLSWIAEEFDSDKKMLSAITESYNHLHNVLMGNENESLRNLLLNIKDYNLEKINITNDLSLTEISQNLFGRYDVFTNGIKNKLRVLTPRKKKETDENFEDRINKIFKTQKSFSIAFLNKLPQPEMEDGKPRNIEDYFITQGAINTKSIQKEDIFAQIENAYEDAQVFLQIKDTDNKLSQNKTAVEKIKTLLDALKELQHFIKPLLGSGEENEKDELFYGSFLAIWDELDTITPLYNKVRNWLTRKPYSTEKIKLNFDNAQLLGGWDVNKEHDCAGILLRKNDSYYLGIINKKTNHIFDTDITPSDGECYDKIDYKLLPGANKMLPKVFFSKSRIKEFEPSEAIINCYKKGTHKKGKNFNLTDCHRLINFFKTSIEKHEDWSKFGFKFSDTETYEDISGFYREVEQQGYRLTSHPVSASYIHSLVKEGKLYLFQIWNKDFSQFSKGTPNLHTLYWKMLFDKRNLSDVVYKLNGQAEVFYRKSSIEHQNRIIHPAQHPITNKNELNKKHTSTFKYDIIKDRRYTVDKFQFHVPITINFKATGQNNINPIVQEVIRQNGITHIIGIDRGERHLLYLSLIDLKGNIIKQMTLNEIINEYKGVTYKTNYHNLLEKREKERTEARHSWSSIESIKELKDGYMSQVIHKITDMMVKYNAIVVLEDLNGGFMRGRQKVEKQVYQKFEKKLIDKLNYLVDKKLDANEVGGVLNAYQLTNKFESFKKIGKQSGFLFYIPAWNTSKIDPITGFVNLFNTRYESIKETKVFWSKFDIIRYNKEKNWFEFVFDYNTFTTKAEGTRTKWTLCTHGTRIQTFRNPEKNAQWDNKEINLTESFKALFEKYKIDITSNLKESIMQETEKKFFQELHNLLHLTLQMRNSVTGTDIDYLISPVADEDGNFYDSRINGKNFPENADANGAYNIARKGLMLIRQIKQADPQKKFKFETITNKDWLKFAQDKPYLKD

SEQ ID NO: 49 - protein, 1231 aa, Butyrivibrio fibrisolvens
  MISC_FEATURE (1)..(1231): Genbank WP_027216152 Cpf1
MYYESLTKLYPIKKTIRNELVPIGKTLENIKKNNILEADEDRKIAYIRVKAIMDDYHKRLINEALSGFALIDLDKAANLYLSRSKSADDIESFSRFQDKLRKAIAKRLREHENFGKIGNKDIIPLLQKLSENEDDYNALESFKNFYTYFESYNDVRLNLYSDKEKSSTVAYRLINENLPRFLDNIRAYDAVQKAGITSEELSSEAQDGLFLVNTFNNVLIQDGINTYNEDIGKLNVAINLYNQKNASVQGFRKVPKMKVLYKQILSDREESFIDEFESDTELLDSLESHYANLAKYFGSNKVQLLFTALRESKGVNVYVKNDIAKTSFSNVVFGSWSRIDELINGEYDDNNNRKKDEKYYDKRQKELKKNKSYTIEKIITLSTEDVDVIGKYIEKLESDIDDIRFKGKNFYEAVLCGHDRSKKLSKNKGAVEAIKGYLDSVKDFERDLKLINGSGQELEKNLVVYGEQEAVLSELSGIDSLYNMTRNYLTKKPFSTEKIKLNFNKPTFLDGWDYGNEEAYLGFFMIKEGNYFLAVMDANWNKEFRNIPSVDKSDCYKKVIYKQISSPEKSIQNLMVIDGKTVKKNGRKEKEGIHSGENLILEELKNTYLPKKINDIRKRRSYLNGDTFSKKDLTEFIGYYKQRVIEYYNGYSFYFKSDDDYASFKEFQEDVGRQAYQISYVDVPVSFVDDLINSGKLYLFRVYNKDFSEYSKGRLNLHTLYFKMLFDERNLKNVVYKLNGQAEVFYRPSSIKKEELIVHRAGEEIKNKNPKRAAQKPTRRLDYDIVKDRRYSQDKFMLHTSIIMNFGAEENVSFNDIVNGVLRNEDKVNVIGIDRGERNLLYVVVIDPEGKILEQRSLNCITDSNLDIETDYHRLLDEKESDRKIARRDWTTIENIKELKAGYLSQVVHIVAELVLKYNAIICLEDLNFGFKRGRQKVEKQVYQKFEKMLIDKLNYLVMDKSREQLSPEKISGALNALQLTPDFKSFKVLGKQTGIIYYVPAYLTSKIDPMTGFANLFYVKYENVDKAKEFFSKFDSIKYNKDGKNWNTKGYFEFAFDYKKFTDRAYGRVSEWTVCTVGERIIKFKNKEKNNSYDDKVIDLTNSLKELFDSYKVTYESEVDLKDAILAIDDPAFYRDLTRRLQQTLQMRNSSCDGSRDYIISPVKNSKGEFFCSDNNDDTTPNDADANGAFNIARKGLWVLNEIRNSEEGSKINLAMSNAQWLEYAQDNTI

SEQ ID NO: 50 - protein, 1235 aa, Anaerovibrio sp.
  MISC_FEATURE (1)..(1235): Genbank WP_027407524 Cpf1
MVAFIDEFVGQYPVSKTLRFEARPVPETKKWLESDQCSVLFNDQKRNEYYGVLKELLDDYYRAYIEDALTSFTLDKALLENAYDLYCNRDTNAFSSCCEKLRKDLVKAFGNLKDYLLGSDQLKDLVKLKAKVDAPAGKGKKKIEVDSRLINWLNNNAKYSAEDREKYIKAIESFEGFVTYLTNYKQARENMFSSEDKSTAIAFRVIDQNMVTYFGNIRIYEKIKAKYPELYSALKGFEKFFSPTAYSEILSQSKIDEYNYQCIGRPIDDADFKGVNSLINEYRQKNGIKARELPVMSMLYKQILSDRDNSFMSEVINRNEEAIECAKNGYKVSYALFNELLQLYKKIFTEDNYGNIYVKTQPLTELSQALFGDWSILRNALDNGKYDKDIINLAELEKYFSEYCKVLDADDAAKIQDKFNLKDYFIQKNALDATLPDLDKITQYKPHLDAMLQAIRKYKLFSMYNGRKKMDVPENGIDFSNEFNAIYDKLSEFSILYDRIRNFATKKPYSDEKMKLSFNMPTMLAGWDYNNETANGCFLFIKDGKYFLGVADSKSKNIFDFKKNPHLLDKYSSKDIYYKVKYKQVSGSAKMLPKVVFAGSNEKIFGHLISKRILEIREKKLYTAAAGDRKAVAEWIDFMKSAIAIHPEWNEYFKFKFKNTAEYDNANKFYEDIDKQTYSLEKVEIPTEYIDEMVSQHKLYLFQLYTKDFSDKKKKKGTDNLHTMYWHGVFSDENLKAVTEGTQPIIKLNGEAEMFMRNPSIEFQVTHEHNKPIANKNPLNTKKESVFNYDLIKDKRYTERKFYFHCPITLNFRADKPIKYNEKINRFVENNPDVCIIGIDRGERHLLYYTVINQTGDILEQGSLNKISGSYTNDKGEKVNKETDYHDLLDRKEKGKHVAQQAWETIENIKELKAGYLSQVVYKLTQLMLQYNAVIVLENLNVGFKRGRTKVEKQVYQKFEKAMIDKLNYLVFKDRGYEMNGSYAKGLQLTDKFESFDKIGKQTGCIYYVIPSYTSHIDPKTGFVNLLNAKLRYENITKAQDTIRKFDSISYNAKADYFEFAFDYRSFGVDMARNEWVVCTCGDLRWEYSAKTRETKAYSVTDRLKELFKAHGIDYVGGENLVSHITEVADKHFLSTLLFYLRLVLKMRYTVSGTENENDFILSPVEYAPGKFFDSREATSTEPMNADANGAYHIALKGLMTIRGIEDGKLHNYGKGGENAAWFKFMQNQEYKNNG

SEQ ID NO: 51 - protein, 1205 aa, Pseudobutyrivibrio ruminis
  MISC_FEATURE (1)..(1205): Genbank WP_028248456 Cpf1
MYYQNLTKMYPISKTLRNELIPVGKTLENIRKNGILEADIQRKADYEHVKKLMDNYHKQLINEALQGVHLSDLSDAYDLYFNLSKEKNSVDAFSKCQDKLRKEIVSLLKNHENFPKIGNKEIIKLLQSLYDNDTDYKALDSFSNFYTYFSSYNEVRKNLYSDEEKSSTVAYRLINENLPKFLDNIKAYAIAKKAGVRAEGLSEEDQDCLFIIETFERTLTQDGIDNYNAAIGKLNTAINLFNQQNKKQEGFRKVPQMKCLYKQILSDREEAFIDEFSDDEDLITNIESFAENMNVFLNSEIITDFKIALVESDGSLVYIKNDVSKTSFSNIVFGSWNAIDEKLSDEYDLANSKKKKDEKYYEKRQKELKKNKSYDLETIIGLFDDNSDVIGKYIEKLESDITAIAEAKNDFDEIVLRKHDKNKSLRKNTNAVEAIKSYLDTVKDFERDIKLINGSGQEVEKNLVVYAEQENILAEIKNVDSLYNMSRNYLTQKPFSTEKFKLNFNRATLLNGWDKNKETDNLGILFEKDGMYYLGIMNTKANKIFVNIPKATSNDVYHKVNYKLLPGPNKMLPKVFFAQSNLDYYKPSEELLAKYKAGTHKKGDNFSLEDCHALIDFFKASIEKHPDWSSFGFEFSETCTYEDLSGFYREVEKQGYKITYTDVDADYITSLVERDELYLFQIYNKDFSPYSKGNLNLHTIYLQMLFDQRNLNNVVYKLNGEAEVFYRPASINDEEVIIHKAGEEIKNKNSKRAVDKPTSKFGYDIIKDRRYSKDKFMLHIPVTMNFGVDETRRFNDVVNDALRNDEKVRVIGIDRGERNLLYVVVVDTDGTILEQISLNSIINNEYSIETDYHKLLDEKEGDRDRARKNWTTIENIKELKEGYLSQVVNVIAKLVLKYNAIICLEDLNFGFKRGRQKVEKQVYQKFEKMLIDKLNYLVIDKSRKQDKPEEFGGALNALQLTSKFTSFKDMGKQTGIIYYVPAYLTSKIDPTTGFANLFYVKYENVEKAKEFFSRFDSISYNNESGYFEFAFDYKKFTDRACGARSQWTVCTYGERIIKFRNTEKNNSFDDKTIVLSEEFKELFSIYGISYEDGAELKNKIMSVDEADFFRSLTRLFQQTMQMRNSSNDVTRDYIISPIMNDRGEFFNSEACDASKPKDADANGAFNIARKGLWVLEQIRNTPSGDKLNLAMSNAEWLEYAQRNQI

SEQ ID NO: 52 - protein, 1154 aa, Proteocatella sphenisci
  MISC_FEATURE (1)..(1154): Genbank WP_028830240 Cpf1
MENFKNLYPINKTLRFELRPYGKTLENFKKSGLLEKDAFKANSRRSMQAIIDEKFKETIEERLKYTEFSECDLGNMTSKDKKITDKAATNLKKQVILSFDDEIFNNYLKPDKNIDALFKNDPSNPVISTFKGFTTYFVNFFEIRKHIFKGESSGSMAYRIIDENLTTYLNNIEKIKKLPEELKSQLEGIDQIDKLNNYNEFITQSGITHYNEIIGGISKSENVKIQGINEGINLYCQKNKVKLPRLTPLYKMILSDRVSNSFVLDTIENDTELIEMISDLINKTEISQDVIMSDIQNIFIKYKQLGNLPGISYSSIVNAICSDYDNNFGDGKRKKSYENDRKKHLETNVYSINYISELLTDTDVSSNIKMRYKELEQNYQVCKENFNATNWMNIKNIKQSEKTNLIKDLLDILKSIQRFYDLFDIVDEDKNPSAEFYTWLSKNAEKLDFEFNSVYNKSRNYLTRKQYSDKKIKLNFDSPTLAKGWDANKEIDNSTIIMRKFNNDRGDYDYFLGIWNKSTPANEKIIPLEDNGLFEKMQYKLYPDPSKMLPKQFLSKIWKAKHPTTPEFDKKYKEGRHKKGPDFEKEFLHELIDCFKHGLVNHDEKYQDVFGFNLRNTEDYNSYTEFLEDVERCNYNLSFNKIADTSNLINDGKLYVFQIWSKDFSIDSKGTKNLNTIYFESLFSEENMIEKMFKLSGEAEIFYRPASLNYCEDIIKKGHHHAELKDKFDYPIIKDKRYSQDKFFFHVPMVINYKSEKLNSKSLNNRTNENLGQFTHIIGIDRGERHLIYLTVVDVSTGEIVEQKHLDEIINTDTKGVEHKTHYLNKLEEKSKTRDNERKSWEAIETIKELKEGYISHVINEIQKLQEKYNALIVMENLNYGFKNSRIKVEKQVYQKFETALIKKFNYIIDKKDPETYIHGYQLTNPITTLDKIGNQSGIVLYIPAWNTSKIDPVTGFVNLLYADDLKYKNQEQAKSFIQKIDNIYFENGEFKFDIDFSKWNNRYSISKTKWTLTSYGTRIQTFRNPQKNNKWDSAEYDLTEEFKLILNIDGTLKSQDVETYKKFMSLFKLMLQLRNSVTGTDIDYMISPVTDKTGTHFDSRENIKNLPADADANGAYNIARKGIMAIENIMNGISDPLKISNEDYLKYIQNQQE

SEQ ID NO: 53 - protein, 1206 aa, Butyrivibrio sp.
  MISC_FEATURE (1)..(1206): Genbank WP_035798880 Cpf1
MYYQNLTKKYPVSKTIRNELIPIGKTLENIRKNNILESDVKRKQDYEHVKGIMDEYHKQLINEALDNYMLPSLNQAAEIYLKKHVDVEDREEFKKTQDLLRREVTGRLKEHENYTKIGKKDILDLLEKLPSISEEDYNALESFRNFYTYFTSYNKVRENLYSDEEKSSTVAYRLINENLPKFLDNIKSYAFVKAAGVLADCIEEEEQDALFMVETFNMTLTQEGIDMYNYQIGKVNSAINLYNQKNHKVEEFKKIPKMKVLYKQILSDREEVFIGEFKDDETLLSSIGAYGNVLMTYLKSEKINIFFDALRESEGKNVYVKNDLSKTTMSNIVFGSWSAFDELLNQEYDLANENKKKDDKYFEKRQKELKKNKSYTLEQMSNLSKEDISPIENYIERISEDIEKICIYNGEFEKIVVNEHDSSRKLSKNIKAVKVIKDYLDSIKELEHDIKLINGSGQELEKNLVVYVGQEEALEQLRPVDSLYNLTRNYLTKKPFSTEKVKLNFNKSTLLNGWDKNKETDNLGILFFKDGKYYLGIMNTTANKAFVNPPAAKTENVFKKVDYKLLPGSNKMLPKVFFAKSNIGYYNPSTELYSNYKKGTHKKGPSFSIDDCHNLIDFFKESIKKHEDWSKFGFEFSDTADYRDISEFYREVEKQGYKLTFTDIDESYINDLIEKNELYLFQIYNKDFSEYSKGKLNLHTLYFMMLFDQRNLDNVVYKLNGEAEVFYRPASIAENELVIHKAGEGIKNKNPNRAKVKETSTFSYDIVKDKRYSKYKFTLHIPITMNFGVDEVRRFNDVINNALRTDDNVNVIGIDRGERNLLYVVVINSEGKILEQISLNSIINKEYDIETNYHALLDEREDDRNKARKDWNTIENIKELKTGYLSQVVNVVAKLVLKYNAIICLEDLNFGFKRGRQKVEKQVYQKFEKMLIEKLNYLVIDKSREQVSPEKMGGALNALQLTSKFKSFAELGKQSGIIYYVPAYLTSKIDPTTGFVNLFYIKYENIEKAKQFFDGFDFIRFNKKDDMFEFSFDYKSFTQKACGIRSKWIVYTNGERIIKYPNPEKNNLFDEKVINVTDEIKGLFKQYRIPYENGEDIKEIIISKAEADFYKRLFRLLHQTLQMRNSTSDGTRDYIISPVKNDRGEFFCSEFSEGTMPKDADANGAYNIARKGLWVLEQIRQKDEGEKVNLSMTNAEWLKYAQLHLL

SEQ ID NO: 54 - protein, 1264 aa, Moraxella caprae
  MISC_FEATURE (1)..(1264): Genbank WP_036388671 Cpf1
MLFQDFTHLYPLSKTMRFELKPIGKTLEHIHAKNFLSQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAITYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGALYDELAKIPTLYNKVRDYLSQKPFSTEKYKLNFGNPTLLNGWDLNKEKDNFGIILQKDGCYYLALLDKAHKKVFDNAPNTGKNVYQKMIYKLLPGPNKMLPKVFFAKSNLDYYNPSAELLDKYAQGTHKKGNNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSKDNLANPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDEADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWKICSHGDKRYVYDKTANQNKGATKGINVNDELKSLFARHHINDKQPNLVMDICQNNDKEFHKSLIYLLKTLLALRYSNASSDEDFILSPVANDEGMFFNSALADDTQPQNADANGAYHIALKGLWVLEQIKNSDDLNKVKLAIDNQTWLNFAQNR

SEQ ID NO: 55 - protein, 1259 aa, Synergistes jonesii; identical to SEQ ID NO: 45
  MISC_FEATURE (1)..(1259): Genbank WP_037975888 Cpf1

SEQ ID NO: 56 - protein, 1264 aa, Prevotella brevis
  MISC_FEATURE (1)..(1264): Genbank WP_044110123 Cpf1
MKQFTNLYQLSKTLRFELKPIGKTLEHINANGFIDNDAHRAESYKKVKKLIDDYHKDYIENVLNNFKLNGEYLQAYFDLYSQDTKDKQFKDIQDKLRKSIASALKGDDRYKTIDKKELIRQDMKTFLKKDTDKALLDEFYEFTTYFTGYHENRKNMYSDEAKSTAIAYRLIHDNLPKFIDNIAVFKKIANTSVADNFSTIYKNFEEYLNVNSIDEIFSLDYYNIVLTQTQIEVYNSIIGGRTLEDDTKIQGINEFVNLYNQQLANKKDRLPKLKPLFKQILSDRVQLSWLQEEFNTGADVLNAVKEYCTSYFDNVEESVKVLLTGISDYDLSKIYITNDLALTDVSQRMFGEWSIIPNAIEQRLRSDNPKKTNEKEEKYSDRISKLKKLPKSYSLGYINECISELNGIDIADYYATLGAINTESKQEPSIPTSIQVHYNALKPILDTDYPREKNLSQDKLTVMQLKDLLDDFKALQHFIKPLLGNGDEAEKDEKFYGELMQLWEVIDSITPLYNKVRNYCTRKPFSTEKIKVNFENAQLLDGWDENKESTNASIILRKNGMYYLGIMKKEYRNILTKPMPSDGDCYDKVVYKFFKDITTMVPKCTTQMKSVKEHFSNSNDDYTLFEKDKFIAPVVITKEIFDLNNVLYNGVKKFQIGYLNNTGDSFGYNHAVEIWKSFCLKFLKAYKSTSIYDFSSIEKNIGCYNDLNSFYGAVNLLLYNLTYRKVSVDYIHQLVDEDKMYLFMIYNKDFSTYSKGTPNMHTLYWKMLFDESNLNDVVYKLNGQAEVFYRKKSITYQHPTHPANKPIDNKNVNNPKKQSNFEYDLIKDKRYTVDKFMFHVPITLNFKGMGNGDINMQVREYIKTTDDLHFIGIDRGERHLLYICVINGKGEIVEQYSLNEIVNNYKGTEYKTDYHTLLSERDKKRKEERSSWQTIEGIKELKSGYLSQVIHKITQLMIKYNAIVLLEDLNMGFKRGRQKVESSVYQQFEKALIDKLNYLVDKNKDANEIGGLLHAYQLTNDPKLPNKNSKQSGFLFYVPAWNTSKIDPVTGFVNLLDTRYENVAKAQAFFKKFDSIRYNKEYDRFEFKFDYSNFTAKAEDTRTQWTLCTYGTRIETFRNAEKNSNWDSREIDLTTEWKTLFTQHNIPLNANLKEAILLQANKNFYTDILHLMKLTLQMRNSVTGTDIDYMVSPVANECGEFFDSRKVKEGLPVNADANGAYNIARKGLWLAQQIKNANDLSDVKLAITNKEWLQFAQKKQYLKD

SEQ ID NO: 57 - protein, 1273 aa, Flavobacterium sp.
  MISC_FEATURE (1)..(1273): Genbank WP_045971446 Cpf1
MKNFSNLYQVSKTVRFELKPIGNTLENIKNKSLLKNDSIRAESYQKMKKTIDEFHKYFIDLALNNKKLSYLNEYIALYTQSAEAKKEDKFKADFKKVQDNLRKEIVSSFTEGEAKAIFSVLDKKELITIELEKWKNENNLAVYLDESFKSFTTYFTGFHQNRKNMYSAEANSTAIAYRLIHENLPKFIENSKAFEKSSQIAELQPKIEKLYKEFEAYLNVNSISELFEIDYFNEVLTQKGITVYNNIIGGRTATEGKQKIQGLNEIINLYNQTKPKNERLPKLKQLYKQILSDRISLSFLPDAFTEGKQVLKAVFEFYKINLLSYKQDGVEESQNLLELIQQVVKNLGNQDVNKIYLKNDTSLTTIAQQLFGDFSVFSAALQYRYETVVNPKYTAEYQKANEAKQEKLDKEKIKFVKQDYFSIAFLQEVVADYVKTLDENLDWKQKYTPSCIADYFTTHFIAKKENEADKTFNFIANIKAKYQCIQGILEQADDYEDELKQDQKLIDNIKFFLDAILEVVHFIKPLHLKSESITEKDNAFYDVFENYYEALNVVTPLYNMVRNYVTQKPYSTEKIKLNFENAQLLNGWDANKEKDYLTTILKRDGNYFLAIMDKKHNKTFQQFTEDDENYEKIVYKLLPGVNKMLPKVFFSNKNIAFFNPSKEILDNYKNNTHKKGATFNLKDCHALIDFFKDSLNKHEDWKYFDFQFSETKTYQDLSGFYKEVEHQGYKINFKKVSVSQIDTLIEEGKMYLFQIYNKDFSPYAKGKPNMHTLYWKALFETQNLENVIYKLNGQAEIFFRKASIKKKNIITHKAHQPIAAKNPLTPTAKNTFAYDLIKDKRYTVDKFQFHVPITMNFKATGNSYINQDVLAYLKDNPEVNIIGLDRGERHLVYLTLIDQKGTILLQESLNVIQDEKTHTPYHTLLDNKEIARDKARKNWGSIESIKELKEGYISQVVHKITKMMIEHNAIVVMEDLNFGFKRGRFKVEKQIYQKLEKMLIDKLNYLVLKDKQPHELGGLYNALQLTNKFESFQKMGKQSGFLFYVPAWNTSKIDPTTGFVNYFYTKYENVEKAKTFFSKFDSILYNKTKGYFEFVVKNYSDFNPKAADTRQEWTICTHGERIETKRQKEQNNNFVSTTIQLTEQFVNFFEKVGLDLSKELKTQLIAQNEKSFFEELFHLLKLTLQMRNSESHTEIDYLISPVANEKGIFYDSRKATASLPIDADANGAYHIAKKGLWIMEQINKTNSEDDLKKVKLAISNREWLQYVQQVQKK

SEQ ID NO: 58 - protein, 973 aa, Sneathia amnii
  MISC_FEATURE (1)..(973): Genbank WP_046328599 Cpf1
MTEEDTKSFVDEILLTPESVIKTIDNFIDSIIMNDIEGLKEEFLKISLENFEGIYISNKKLNEISNRKFGDYNSINMMIKQSMNEKGILSKKEINELIPDLENINKPKVKSFNLSFIFENLTKEHKELIIDYIRENICNVIENVKITIEKYRNIDNKIEFKNNAEKVSKIKEMLESINELCKLIKEFNTDEIEKNNEFYNILNKNFEIFESSYKVLNKVRNFVTKKEVIENKMKLNFSNYQLGNGWHKNKEKDCSIILFRKRNNERWIYYLGILKHGTKIKENDYLSSVDTGFYKMDYYAQNSLSKMIPKCSITVKNVKNAPEDESVILNDSKKFNEPLEITPEIRKLYGNNEHIKGDKFKKESLVKWIDFCKEFLLKYKSFEKAKKEILKLKESNLYENLEEFYSDAEEKAYFLEFINIDEDKIKKLVKEKNLYLFQIYNKDFSAYSTGNKNLHTMYFEELFTDENLKKPVFKLNGNTEVFYRIASSKPKIVHNKGEKLVNKTYLDDGIIKTIPDSVYEEISEKVKNNEDYSKLLEENNIKNLEIKVATHEIVKDKRYFENKFLFYLPITLNKKVSNKNTNKNINKNVIDEIKDCNEYNVIGIDRGERNLISLCIINQNGEIILQKEMNIIQSSDKYNVDYNEKLEIKSKERDNAKKNWSEIGKIKDLKSGYLSAVVHEIVKLAIEYNAVIILEDLNNGFKNSRKKVDKQIYQKFERALIEKLQFLIFKNYDKNEKGGLRNAFQLTPELKNITKVASQQGIIIYTNPAYTSKIDPTTGYANIIKKSNNNEESIVKAIDKISYDKEKDMFYFDINLSNSSFNLTVKNVLKKEWRIYTNGERIIYKDRKYITLNITQEMKDILSKCGIDYLNIDNLKQDILKNKLHKKVYYIFELANKMRNENKDVDYIISPVLNKDGKFFMTQEINELTPKDADLNGAYNIALKGKLMIDNLNKKEKFVFLSNEDWLNFIQGR

SEQ ID NO: 59 - protein, 1238 aa, Candidatus Methanoplasma
  MISC_FEATURE (1)..(1238): Genbank WP_048112740 Cpf1
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 60 - protein, 1222 aa, Oribacterium sp.
  MISC_FEATURE (1)..(1222): Genbank WP_049895985 Cpf1
METEILKYDFFEREGKYMYYDGLTKQYALSKTIRNELVPIGKTLDNIKKNRILEADIKRKSDYEHVKKLMDMYHKKIINEALDNFKLSVLEDAADIYFNKQNDERDIDAFLKIQDKLRKEIVEQLKGHTDYSKVGNKDFLGLLKAASTEEDRILIESFDNFYTYFTSYNKVRSNLYSAEDKSSTVAYRLINENLPKFFDNIKAYRTVRNAGVISGDMSIVEQDELFEVDTFNHTLTQYGIDTYNHMIGQLNSAINLYNQKMHGAGSFKKLPKMKELYKQLLTEREEEFIEEYTDDEVLITSVHNYVSYLIDYLNSDKVESFFDTLRKSDGKEVFIKNDVSKTTMSNILFDNWSTIDDLINHEYDSAPENVKKTKDDKYFEKRQKDLKKNKSYSLSKIAALCRDTTILEKYIRRLVDDIEKIYTSNNVFSDIVLSKHDRSKKLSKNTNAVQAIKNMLDSIKDFEHDVMLINGSGQEIKKNLNVYSEQEALAGILRQVDHIYNLTRNYLTKKPFSTEKIKLNFNRPTFLDGWDKNKEEANLGILLIKDNRYYLGIMNTSSNKAFVNPPKAISNDIYKKVDYKLLPGPNKMLPKVFFATKNIAYYAPSEELLSKYRKGTHKKGDSFSIDDCRNLIDFFKSSINKNTDWSTFGFNFSDTNSYNDISDFYREVEKQGYKLSFTDIDACYIKDLVDNNELYLFQIYNKDFSPYSKGKLNLHTLYFKMLFDQRNLDNVVYKLNGEAEVFYRPASIESDEQIIHKSGQNIKNKNQKRSNCKKTSTFDYDIVKDRRYCKDKFMLHLPITVNFGTNESGKFNELVNNAIRADKDVNVIGIDRGERNLLYVVVVDPCGKIIEQISLNTIVDKEYDIETDYHQLLDEKEGSRDKARKDWNTIENIKELKEGYLSQVVNIIAKLVLKYDAIICLEDLNFGFKRGRQKVEKQVYQKFEKMLIDKMNYLVLDKSRKQESPQKPGGALNALQLTSAFKSFKELGKQTGIIYYVPAYLTSKIDPTTGFANLFYIKYESVDKARDFFSKFDFIRYNQMDNYFEFGFDYKSFTERASGCKSKWIACTNGERIVKYRNSDKNNSFDDKTVILTDEYRSLFDKYLQNYIDEDDLKDQILQIDSADFYKNLIKLFQLTLQMRNSSSDGKRDYIISPVKNYREEFFCSEFSDDTFPRDADANGAYNIARKGLWVIKQIRETKSGTKINLAMSNSEWLEYAQCNLL

SEQ ID NO: 61 - protein, 1326 aa, Prevotella disiens
  MISC_FEATURE (1)..(1326): Genbank WP_050786240 Cpf1
MKVMENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 62 - protein, 998 aa, Arcobacter butzleri
  MISC_FEATURE (1)..(998): Genbank WP_052943011 Cpf1
MGLLEHLEGAIVEDMFSLDYFSLTLSQRYIDIYNTMIGGNTLADGTKVQGINENINIYRQKNNIDRKNLPTLKPLHKQLLSDRETLSWIPEAFKTKEEVVGAIEDFYKNNIISFKCCDNIVDITKQFIDIFSLNEDYELNKIFIKNDISITSISQDIFKDYRIIKEALWQKHINENPKAAKSKDLTGDKEKYFSRKNSFFSFEEIISSLKLMGRKIDLFSYFKDNVEYRAHSIETTFIKWQKNKNDKKTTKELLDNILNLQRVLKPLYLKAEVEKDILFYSIFDIYFESLNEIVKLYNKVRDFESKKPYSLEKFKLNFQNSTLLSGWDVNKEPDNTSILLKKDGLYYLGIMDKKHNRVFKNLESSKGGYEKIEYKLLSGPNKMLPKVFFSNKSIGYYNPSPALLEKYKSGVHKKGESFDLNFCHELIDFFKASIDKHEDWKNFNFKFSDTSEYADISGFYREVEQQGYKITFKNIDEEFINTLINEGKLYLFQIYNKDFSTFSKGTKNLHTLYWEMIFNEENLKNVVYKLNGEAEIFYRKKSIEYSEDKMKYGHHYEELKDKFNYPIIKDKRFTMDKFQFHVPITMNFKATGRSYINEEVNDFLRQNSKDVKIIGINRGERHLIYLTMINAKGEIIQQYSLNEIVNSYNNKNFTVNYNEKLSKKEGERAIARENWGVVENIKELKEGYLSHAIHTISNLIVENNAIVVLEDLNFEFKRERLKVEKSIYQKFEKMLIDKLNYLVDKKKDINENGGLLKALQLTNKFESFEKIGKQNGFLFFVNAWNITKICPVTGFVSLFDTRYQSVDKAREFFSKFDSIKYNEEKEHYEFVFDYSNFTDKAKDTKTKWTVCSYGTRIKTFRNSEKNNNWDNKTVSPTEDLSKLLKSCDRDIKEFIISQDKKEFFVELLEIFSLIVQMKNSIINSEIDYIISPVANENGEFFDSRFANSSLPKNADANAAYNTARKGLMLLEKIRDSEIGKKIDMKITNTEWLNFVQER

SEQ ID NO: 63 - protein, 1475 aa, Treponema endosymbiont of Eucomonympha sp.
  MISC_FEATURE (1)..(1475): Genbank WP_062376669 Cpf1
MTAFEELTNLYSVSKTLRFELKPAGKDGNTLSAEESAKLFKEILDQDRKIKDAYLALKPVMDTIHEKIINSSLGSDEARQIDFSAYYIEYNKKDNEYAVKKAEESLRAAIRSAFDKAANELAKNAGNDEKGKPIFKKKKGKDVGVEYLTQAGIIKYIENHIKTLVPQKVKEFIDKKNVINAKGKKITERTGHLAVFDSFFTYFGGYNTNRKNYYTEDKEKATAVATRIVHDNLPKFCDNCIQFSQDKIVTKRKSKETIPARKDEYLNAYQFLKDSEKTTQIKDAATNTMIEAYPVDERTFEIARFSECLTQAGIEEYNRIIGHYNSLINLYNQTRKGESDFRKLEQFKTLHKQIGCGEKKGWRDALKDNEDLKGKLKAISEAGQKYFTASLNPDDITFFSFIDWLKKNEDWDGVYWSKSAVDKVSGVYFANWHDIKDRLKGNKACVHLDKNKELQINDAVELSGLFAVINSGNSESADIHAQEHGLFDALNQENNEDLSKTLFKQSVLDEKASLIDEKLSASKNLINLICADMENLANAFCETSAEIMKITDFKNEANILSIKNWLDTAKSLIWRVKDFDIKESKRKGNAINAELSNMLTELLHADDARWFDWYDLVRNYLTKKPQDDAKANKLKLNFGYGKLLDGFVDSHTDESDASTQYGGYLFRKRTDAQEKSDFEYFLGISKNTKLFRCHLQSTVQNHDKSNFERLEYYQAKSTTYFDAKYSENKAKLVEIIESLIDDRAKTDSELTVIGNEIKKRDGKGEITPSALFDRVKKDKAFSRILNDDTLLKAVTQAIRDLQNSCDNFSERAPRLKEVQKRGYFGIVGFKQIVEDLQTVAKENKVFNFFNVSQPEFENAFISGGKRIYLFKISNKDLSYSETSQKDENGQQKRNFKGIENLHTHYFRALMREYKNCTNVDLGKGEIFFRAPVPEIKKEATHKVYDKMVNRRENETHIAIPEKVHNELLLFANEKIAVNNLSNETKLYLDQNKKIDESRVKIKDVKHDIIKDKRFTEAKYQLHLSILLNFTPTKEEVNAKINDTFTKSDDIQFLGIDRGEKHLIYYSLVDANGTIRAQDHFDVINKTDYLQKITEAAKIRREKQENWQQKGNISNLKDGYISLVVHEIIEKMKDENGSFKPMFIVLEDLNTGFKRSRQKFEQQVYQKFELALAKKLNYLVDKNAKDGELASVSRALQLTPLVMNYQDIENRKQVGIMLYTRANYTSVTDPATGWRKTVYLKPGSEESIKKQILGVFSEIGVDEKGDYFFQYSDTNTERTWRLWSSKNGKSLERYRGRRDKNTNAFTVEPYDVKATLNKLFVGFDKDMSLLKQLKDGKTLSKIDGRKETAWESLRFVIDLIQQIRNSGDTSKNQDDNFLLSPVRNAQGEHFDSRLYQNQETPKLPKDADANGAYNIARKGIIMYAHIRQWINDGGQRFEKSSDLDLFVSDNEWDLWLFDSKQWKEQLQKFASRKQKK

SEQ ID NO: 64 - protein, 1251 aa, Moraxella lacunata
  MISC_FEATURE (1)..(1251): Genbank WP_062499108 Cpf1
MLFQDFTHLYPLSKTVRFELKPIGKTLEHIHAKNFLSQDETMADMYQKVKAILDDYHRDFITKMMSEVTLTKLPEFYEVYLALRKNPKDDTLQKQLTEIQTALREEVVKPIDSGGKYKAGYERLFGAKLFKDGKELGDLAKFVIAQEGESSPKLPQIAHFEKFSTYFTGFHDNRKNMYSSDDKHTAIAYRLIHENLPRFIDNLQILVTIKQKHSVLYDQIVNELNANGLDVSLASHLDGYHKLLTQEGITAYNRIIGEVNSYTNKHNQICHKSERIAKLRPLHKQILSDGMGVSFLPSKFADDSEMCQAVNEFYRHYAHVFAKVQSLFDRFDDYQKDGIYVEHKNLNELSKQAFGDFALLGRVLDGYYVDVVNPEFNDKFAKAKTDNAKEKLTKEKDKFIKGVHSLASLEQAIEHYIAGHDDESVQAGKLGQYFKHGLAGVDNPIQKIHNSHSTIKGFLERERPAGERTLPKIKSDKSLEMTQLRQLKELLDNALNVVHFAKLLTTKTTLDNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMVYKLLPGSNKMLPKVFFAKSNLDYYNPSAELLDKYAQGTHKKGDNFNLKDCHALIDFFKASINKHPEWQHFGFEFSLTSSYQDLSDFYREVEPQGYQVKFVDIDADYIDELVEQGQLYLFQIYNKDFSPKAHGKPNLHTLYFKALFSEDNLANPIYKLNGEAEIFYRKASLDMNETTIHRAGEVLENKNPDNPKERQFVYDIIKDKRYTQDKFMLHVPITMNFGVQGMTIKEFNKKVNQSIQQYDEVNVIGIDRGERHLLYLTVINSKGEILEQRSLNDIITTSANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADNEIGSYKNALQLTNNFTDLKSIGKQTGFLFYVPAWNTSKIDPVTGFVDLLKPRYENIAQSQAFFDKFDKICYNADKGYFEFHIDYAKFTDKAKNSRQIWTICSHGDKRYVYDKTANQNKGATIGINVNDELKSLFARYRINDKQPNLVMDICQNNDKEFHKSLTYLLKALLALRYSNASSDEDFILSPVANDKGVFFNSALADDTQPQNADANGAYHIALKGLWLLNELKNSDDLDKVKLAIDNQTWLNFAQNR

SEQ ID NO: 65 - DNA, 50 bp, Artificial Sequence
  Chemically synthesized cTAG_A sequence
actgggtggaatcccttctgcagcacctggattaccctgttatccctagt

SEQ ID NO: 66 - DNA, 50 bp, Artificial Sequence
  Chemically synthesized cTAG_B sequence
taatgagtagtcctcatctccctcaagcaggcgccggcggtactgccatc

SEQ ID NO: 67 - DNA, 50 bp, Artificial Sequence
  Chemically synthesized cTAG_C sequence
catataatctccctcaagcaggccccgctggcgcgcgcgaatgttaggaa

SEQ ID NO: 68 - DNA, 50 bp, Artificial Sequence
  Chemically synthesized cTAG_D sequence
gcctataatgtgaagagcttcactgagtagggcccgggctgtaaacggtt

SEQ ID NO: 69 - DNA, 50 bp, Artificial Sequence
  Chemically synthesized cTAG_E sequence
attcgctagcagatgtagtgtttccacaggggcgatcgctgatatgggtc

SEQ ID NO: 70 - DNA, 50 bp, Artificial Sequence
  Chemically synthesized cTAG_F sequence
actacctagctgcattttcaggaggaagcgatgggcggccgcacaccttc

SEQ ID NO: 71 - DNA, 50 bp, Artificial Sequence
  Chemically synthesized cTAG_G sequence
tgataatgggtgagtgagtgtgtgcgtgtggggcgcgccagatgggaaca

SEQ ID NO: 72 - DNA, 50 bp, Artificial Sequence
  Chemically synthesized cTAG_H sequence
actccagtctttctagaagatggcaaacagctattatgggtattatgggt

SEQ ID NO: 73 - DNA, 50 bp, Artificial Sequence
  Chemically synthesized cTAG_I sequence
tagtggacggggccactagggacaggattggcctgcaggattcccgtcaa

SEQ ID NO: 74 - DNA, 42 bp, Artificial Sequence
  Chemically synthesized cTAG_J sequence
tgaactaaggcggctgcacaaccagtggaggcctaaatgatc

SEQ ID NO: 75 - DNA, 25 bp, Artificial Sequence
  Chemically synthesized tagD_FWD PCR primer
gcctataatgtgaagagcttcactg

SEQ ID NO: 76 - DNA, 19 bp, Artificial Sequence
  Chemically synthesized tagE_REV PCR primer
gacccatatcagcgatcgc

SEQ ID NO: 77 - DNA, 9312 bp, Artificial Sequence
  Plasmid 13000444591
tccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgactccagtctttctagaagatggcaaacagctattatgggtattatgggtccccgaagcagggttatgcagcggaaaagctccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttattttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagccggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggactgggtggaatcccttctgcagcacctggattaccctgttatccctagttttgatgggtatcggtattgctactggggaaaatcgcgcggcagaggcagcaaaaaaagcaatttccagcccgcttcttgaagcggccattgacggtgcgcaaggcgtcctcatgaacatcactggaggaacaaacctcagcctatatgaggttcaggaagcagcagacattgtcgcttcggcgtctgatcaagacgtaaacatgattttcggttctgttattaatgaaaatctaaaagatgagattgtggtgacagtgattgcaaccggctttatcgaacaagagaaggacgtgacgaagcctcagcgcccaagcttaaatcaaagcatcaaaacacacaatcaaagtgttccgaagcgtgacgcaaaacgtgaggaacctcagcagcagaacacagtaagccgtcatacttcacagccggctgatgatacgcttgacatcccgacattcttaagaaaccgtaataaacgcggctaatgtaaaggacaaaatcgttttcgattttgtcttttttgtttttctcttcacacttccttcttataaagtctttttccctattgctttccttcgcttagtaacaaaacagataattagacccatttatttttgtgacatttttatcattttcatatatatggaaattgaatgacatgaaacgacaatatctgtaattcagattgtctacagttaatatacagcgatgttctgacaaaccattcattattaaaaggagggacgacactttttttaaaaagcatgttgaaaaagggggatgaaaatgaggaaaaaaacgaaaaacagactcatcagctctgttttaagtacagttgtcatcagttcactgctgtttccgggagcagccggggcaagcagtaaagtcacctcaccttctgttaaaaaggagcttcaatctgcggaatccattcaaaacaagatttcgagttcattaaagaaaagctttaaaaagaaagaaaaaacgacttttctgattaaatttaaagatcttaatgagtagtcctcatctccctcaagcaggcgccggcggtactgccatccaaaaatcagaccagacaaaagcggcaaatgaataagcggaacggggaaggatttgcggtcaagtccttcccttccgcacgtatcaattcgcaagcttttcctttataatagaatgaatgagaaggatgaaaccgaatgaacacttatgaacaaattaacaaagtgaaaaagatcttacgcaaacacttgaaaaataacttaattggcacatacatgttcggtagcggagtagaaagcggccttaaaccgaacagcgaccttgacttccttgttgttgtttcagagcctttaacggatcaatctaaagaaattttaatccagaaaattcgcccaatctctaaaaaaatcggagacaaatcaaatctgcgctatatcgaacttacaattattattcaacaagagatggtcccatggaatcaccctccgaaacaagagttcatttacggtgagtggttgcaggaactctatgaacaaggatatatcccgcagaaggagcttaactccgatcttactatcatgctttaccaagcgaaacgtaaaaataaacgtatctacggtaactacgatctcgaagaacttcttcctgatattccattctctgatgttcgccgcgccatcatggatagctctgaagaactcatcgacaactaccaggacgatgaaacaaactctattcttacattatgtcgcatgattcttactatggatacgggtaaaatcatcccaaaggatattgcaggaaacgcagtagctgaatcctcccctcttgagcatcgcgaacgcattcttcttgctgtacgttcttaccttggggaaaatatcgaatggacaaacgaaaatgttaatttaacaatcaactatcttaacaaccgccttaaaaaactgtgaaaaaaagcgcagctgaaatagctgcgcttttttgtgtcataacatataatctccctcaagcaggccccgctggcgcgcgcgaatgttaggaaacgattagtcttttgactgtttgacggtggtggtactggggcctataatgtgaagagcttcactgagtagggcccgggctgtaaacggttaattttgtcaaaataattttattgacaacgtcttattaacgttgatataatttaaattttatttgacaaaaatgggctcgtgttgtacaataaatgttactagagaaaggtggtgaatactagatgacggcattgacggaaggtgcaaaactgtttgagaaagagatcccgtatatcaccgaactggaaggcgacgtcgaaggtatgaaatttatcattaaaggcgagggtaccggtgacgcgaccacgggtaccattaaagcgaaatacatctgcactacgggcgacctgccggtcccgtgggcaaccctggtgagcaccctgagctacggtgttcagtgtttcgccaagtacccgagccacatcaaggatttctttaagagcgccatgccggaaggttatacccaagagcgtaccatcagcttcgaaggcgacggcgtgtacaagacgcgtgctatggttacctacgaacgcggttctatctacaatcgtgtcacgctgactggtgagaactttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacattacctaccacaccaaactgagcaaagaccgcgacgagcgccgtgatcacatgtgtctggtagaggtcgtgaaagcggttgatctggacacgtatcagtaaaaaaaaagcgcagctgaaatagctgcgcttttttgtgtcataaccctttacagtcataaaaattatggtataatcatttctgttgtctttttaaagacacaagcatgaccattatgactagattcgctagcagatgtagtgtttccacaggggcgatcgctgatatgggtccagttcaaaagggattatggtcgataaagatttttatctcgtatatatccagtcgaaacctgatccgtattcacctggattggcaatggatgaaaccggccagaattccggccgcaactggcagtatatagatggaaagtggcagccaggtgacaaagcggatggcaactatatgattcgcgcattagttgattatgaagctgctgtacctgagattacttcaccgacagacaaatcatacacaaataaggatagcgtcactgtaaaaggaaacgcttctcctggcacaacggtacacatttataatggagagaaagaagcaggagaaacgaaagctgctgcggatggcacgttccatgcaggcatcatactcaacaagggtgaaaatgagctgacggcaactgcatcaactgacaacggaacaacagatgcctccagcccaatcacggtcacgcttgatcaagaaaagcctgaattaacactggacaatccaaaggatggcgggaaaacaaataaagaaacgctgactgtcaaaggggctgtatccgatgacaatctgaaagacgtcaaggtgaatggcaaaaaagcaacagtagctgatggttcatactcagcccgtattcttttggaaaatggaagaaatgaaatcaaggtaattgctacagacttggcaggcaacaaaacgacgaaaaagacagtcattgatgtgaactttgacaagcctgtcatttccggcttaattccgggagaggataaaaacttaaaagccggtgaatctgtgaaaatcgctttctcaagcgctgaggatttagatgcaacgtttaccattcgtatgccgctgaccaatgcaagagcgagtgtgcaaaatgccaccgaactcccgttaagagaaatctctccggggagatatgaaggctattggactgccacttcttctattaaagcaaaaggagcaaaagtagaagtgatcgtccgagatgattatggaaatgaaacaagaaaaactgcgaatggaaaacttaatatgaacacagaaaatactacctagctgcattttcaggaggaagcgatgggcggccgcacaccttctatgcggtgtgaaataccgccatgacccttaaatattctgacaaatgctctttccctaaactccccccataaaaaaacccgccgaagcgggtttttacgttatttgcggattaacgattactcgttatcagaaccgcccaggatgcctggcagttccctactctcgccgctgcgctcggtcgttcggctgcgggacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaagcctcactcattaggcaccccaggctttacactgataatgggtgagtgagtgtgtgcgtgtggggcgcgccagatgggaacagctagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctagaggatcgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaa

SEQ ID NO: 78 - DNA, 50 bp, Artificial Sequence
  Chemically synthesized cloning tag cTag K from pMLN005
gcagatgtagtgtttccacagggccccccttattaaatgacttctcgaaa

SEQ ID NO: 79 - DNA, 77 bp, Artificial Sequence
  Chemically synthesized cloning tag cTag L from pMLN005
tttcgtctagagccttttgtataaaaattagggaccttgcactgactgccccccggtgagtgagtgtgtgcgtgtgg

SEQ ID NO: 80 - DNA, 50 bp, Artificial Sequence
  Chemically synthesized cloning tag cTag K' from pMAS006
gcagatgtagtgtttccacagggtttcgagaagtcatttaataagccccc

SEQ ID NO: 81 - DNA, 50 bp, Artificial Sequence
  Chemically synthesized cloning tag cTag L' from pMAS006
aaaaaatacaaaaggctctagacgaaaggtgagtgagtgtgtgcgtgtgg

SEQ ID NO: 82 - DNA, 2781 bp, Artificial Sequence
  Synthetically constructed plasmid pMLN005 CamR in vitro
gcattttcaggaggaagcgatgggcggccgcacaccttctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctgataattgtaggctggataagatgcgtcagcatcgcatccggcaaaggcagatctcgcagatgtagtgtttccacagggcccccttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtaaaaattagggaccttgcactgactgccccccggtgagtgagtgtgtgcgtgtggtcagaattggttaattggttgtaacactgacccctatttgtttatttttctaaatacattcaaatatgtatccgctcatgagacaataaccctgataaatgcttcaataatattgaaaaaggaagaatatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcgatggcaacaacgttgcgcaaactattaactggcgaactacttactctagcttcccggcaacaattaatagactggatggaggcggataaagttgcaggaccacttctgcgctcggcccttccggctggctggtttattgctgataaatccggagccggtgagcgtggttctcgcggtatcatcgcagcgctggggccagatggtaagccctcccgtatcgtagttatctacacgacggggagtcaggcaactatggatgaacgaaatagacagatcgctgagataggtgcctcactgattaagcattggtaataatgaagcgatagcgccggcttagtcagatttaatctgcgcgcgtggtggatatt

SEQ ID NO: 83 - DNA, 3128 bp, Artificial Sequence
  Synthetically constructed plasmid 13000789485 pMLN 005
gcattttcaggaggaagcgatgggcggccgcacaccttctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctgataattgtaggctggataagatgcgtcagcatcgcatccggcaaaggcagatctcgcagatgtagtgtttccacagggccccccttattaaatgacttctcgaaactgtggataaccgtattaccgccggcggtgttgacataaataccactggcggtgatactgagcacatcagcaggtcacacaggaaagtactagatgtcgcatcttgcagaattagtagcttcagcgaaggccgcgatttctcaggcgagtgacgtcgcagcactggataatgtacgtgttgagtacctgggaaagaagggacaccttactcttcaaatgacaaccctgcgcgaactgccgccggaggaacgccccgcagcaggagcggtaatcaatgaggcaaaggagcaagtacaacaggcactgaacgcccgtaaggctgagttggaatccgccgcattaaacgcgcgccttgctgcggaaaccattgatgtctcgctgcccgggcgccgcattgagaatggaggcttacacccagtgactcgtaccatcgaccgtatcgaatctttctttggcgaacttggcttcactgtggcaactggaccggagattgaggacgactaccacaatttcgatgccttgaacattcccggtcatcatcctgcacgcgccgatcatgatacattctggtttgataccacccgtttgcttcgtacccagacaagcggtgtccaaatccgtacgatgaaggctcagcaaccaccgatccgtatcattgctccagggcgcgtgtaccgtaacgattatgaccagacacatacaccgatgtttcaccaaatggaagggttgattgtggatacgaatatctctttcacgaatctgaagggcaccttacatgatttcttacgcaactttttcgaggaggaccttcaaattcgctttcgtccatcgtacttcccttttgcagaaccttcggctgaagtggatgtaatggggaaaaacggtaagtggctggaggttttaggttgcgggatggttcatccaaatgtgcttcgcaacgtcggcatcgaccccgaagtctacagtggattcggattcgggatgggaatggaacgtctgactatgcttcgttacggcgtaacggatttgcgctccttttttgagaacgatcttcgttttctgaagcaattcaaataagcatttttagtacgtgcaataaccactctggtttttccagggtggttttttgatgccctttttggagtcttcaactgctgcgttatcccctgattctgtgtttcgtctagagccttttgtataaaaattagggaccttgcactgactgccccccggtgagtgagtgtgtgcgtgtggtcagaattggttaattggttgtaacactgacccctatttgtttatttttctaaatacattcaaatatgtatccgctcatgagacaataaccctgataaatgcttcaataatattgaaaaaggaagaatatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcgatggcaacaacgttgcgcaaactattaactggcgaactacttactctagcttcccggcaacaattaatagactggatggaggcggataaagttgcaggaccacttctgcgctcggcccttccggctggctggtttattgctgataaatccggagccggtgagcgtggttctcgcggtatcatcgcagcgctggggccagatggtaagccctcccgtatcgtagttatctacacgacggggagtcaggcaactatggatgaacgaaatagacagatcgctgagataggtgcctcactgattaagcattggtaataatgaagcgatagcgccggcttagtcagatttaatctgcgcgcgtggtggatatt

SEQ ID NO: 84 - DNA, 2498 bp, Artificial Sequence
  Synthetically constructed plasmid 13000823784 pMAS006
acgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcagatgtagtgtttccacagggtttcgagaagtcatttaataagcccccttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtaaaaaatacaaaaggctctagacgaaaggtgagtgagtgtgtgcgtgtgggtcgactctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagggtttagttcgttagccatgagggtttagttcgttaaacatgagagcttagtacgttaaacatgagagcttagtacgtgaaacatgagagcttagtacgtactatcaacaggttgaactgctgatcttcttctttcctgcgttatcccctgattctgtggataaccgtattaccgcctttgagtgagctgataccgctcgccgcagccga

SEQ ID NO: 85 - DNA, 11567 bp, Artificial Sequence
  Synthetically constructed plasmid 13000283399
actacctagctgcattttcaggaggaagcgatgggcggccgcacaccttctatgcggtgtgaaataccgccatgacccttaaatattctgacaaatgctctttccctaaactccccccataaaaaaacccgccgaagcgggtttttacgttatttgcggattaacgattactcgttatcagaaccgcccaggatgcctggcagttccctactctcgccgctgcgctcggtcgttcggctgcgggacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaagcctcactcattaggcaccccaggctttacactgataatgggtgagtgagtgtgtgcgtgtggggcgcgccagatgggaacagctagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctagaggatcgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgactccagtctttctagaagatggcaaacagctattatgggtattatgggtccccgaagcagggttatgcagcggaaaagctccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttattttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagccggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggactgggtggaatcccttctgcagcacctggattaccctgttatccctagtaacaaaattctccagtcttcacatcggtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgaaatagtacataataatgagtagtcctcatctccctcaagcaggcgccggcggtactgccatctcatgtttgacagcttatcatcggcaatagttacccttattatcaagataagaaagaaaaggatttttcgctacgctcaaatcctttaaaaaaacacaaaagaccacattttttaatgtggtctttattcttcaactaaagcacccattagttcaacaaacgaaaattggataaagtgggatatttttaaaatatatatttatgttacagtaatattgacttttaaaaaaggattgattctaatgaagaaagcagacaagtaagcctcctaaattcactttagataaaaatttaggaggcatatcaaatgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataatatgagataatgccgactgtactttttacagtcggttttctaatgtcactaacctgccccgttagttgaagaaggtttttatattacagctccagatcctctacgccggacgcatcgtggcatataatctccctcaagcaggccccgctggcgcgcgcgaatgttaggaaacgattagtcttttgactgtttgacggtggtggtactggggcctataatgtgaagagcttcactgagtagggcccgggctgtaaacggttgaattcgcggccgcttctagagggagttctgagaattggtatgccttataagtccaattaacagttgaaaacctgcataggagagctatgcgggttttttattttacataatgatacataatttaccgaaacttgcggaacataattgaggaatcatagaattttgtcaaaataattttattgacaacgtcttattaacgttgatataatttaaattttatttgacaaaaatgggctcgtgttgtacaataaatgtagttactagtagcggccgctgcagggatccacagtacataaaaaaggagacatgacgatggtcgttttacaacgtgactgggtcgaccgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtaacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgttggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattaattccagctgagcgccggtcgctaccattaccagttggtctggtgtcaaaaataataataaccgggcaggccatgtctgcccgtatttcgcgtaaggaaatccaattcgctagcagatgtagtgtttccacaggggcgatcgctgatatgggtcgtcgatcgacatggatgagcgatgatgatatccgtttaggctgggcggtgatagcttctcgttcaggcagtacgcctcttttcttttccagacctgagggaggcggaaatggtgtgaggttccccagatctgggggaaaagccaaataggcgatcgcgggagtgctttatttgaagatcaggctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtctctatcaatacggcaacaaaattgcctgatggcaggtatgacaataaagctggagcgggttcatttcaagtgaacgatggtaaactgacaggcacgatcaatgccaggtctgtagctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagacgacaggcgtttaaggatggagatcaattcacaatcggaaaaggagatccaatttggcaaaacatacaccatcatgttaaaaggaacgaacagtgatggtgtaacgaggaccgagaaatacagttttgttaaaagagatccagcgtcggccaaaaccatcggctatcaaaatccgaatcattggagccaggtaaatgcttatatctataaacatgatgggagccgagtaattgaattgaccggatcttggcctggaaaaccaatgactaaaaatgcagacggaatttacacgctgacgctgcctgcggacacggatacaaccaacgcaaaagtgatttttaataatggcagcgcccaagtgcccggtcagaatcagcctggctttgattacgtgctaaatggtttatataatgactcgggcttaagcggttctcttcccc

SEQ ID NO: 86 - DNA, 79 bp, Artificial Sequence
  Chemically synthesized oligonucleotide GFP Cpf1 cTAG M fwd
cagcacctggattaccctgttatccctagttttgggttaaagatggttaaatgattcgaaaataataaagggaaaatca

SEQ ID NO: 87 - DNA, 79 bp, Artificial Sequence
  Chemically synthesized oligonucleotide GFP Cpf1 cTAG N fwd
cagcacctggattaccctgttatccctagttttgggatgttaagagtccctatcttcgaaaataataaagggaaaatca

SEQ ID NO: 88 - DNA, 81 bp, Artificial Sequence
  Chemically synthesized oligonucleotide GFP Cpf1 cTAG P  fwd
cagcacctggattaccctgttatccctagttttgaggagtgttcagtctccgtgaactcgaaaataataaagggaaaatca

SEQ ID NO: 89 - DNA, 79 bp, Artificial Sequence
  Chemically synthesized oligonucleotide GFP Cpf1 cTAG O rvs
cgcttcctcctgaaaatgcagctaggtagttttgaccgccccccccataccccaatcgacatgccgaactcagaagtga

SEQ ID NO: 90 - DNA, 79 bp, Artificial Sequence
  Chemically synthesized oligonucleotide GFP Cpf1 cTAG N rvs
cgcttcctcctgaaaatgcagctaggtagttttgggatgttaagagtccctatcttcgacatgccgaactcagaagtga

SEQ ID NO: 91 - DNA, 51 bp, Artificial Sequence
  Chemically synthesized oligonucleotide CAT01 Cpf1 cTAG M fwd
tttgggttaaagatggttaaatgattcgacatacacataaagtagcttgcg

SEQ ID NO: 92 - DNA, 51 bp, Artificial Sequence
  Chemically synthesized oligonucleotide CAT01 Cpf1 cTAG N fwd
tttgggatgttaagagtccctatcttcgacatacacataaagtagcttgcg

SEQ ID NO: 93 - DNA, 53 bp, Artificial Sequence
  Chemically synthesized oligonucleotide CAT01 Cpf1 cTAG P fwd
tttgaggagtgttcagtctccgtgaactcgacatacacataaagtagcttgcg

SEQ ID NO: 94 - DNA, 49 bp, Artificial Sequence
  Chemically synthesized oligonucleotide CAT01 Cpf1 cTAG N rvs
tttgggatgttaagagtccctatcttcgactggaaggacaagggggacc

SEQ ID NO: 95 - DNA, 49 bp, Artificial Sequence
  Chemically synthesized oligonucleotide CAT01 Cpf1 cTAG O rvs
tttgaccgccccccccataccccaatcgactggaaggacaagggggacc

SEQ ID NO: 96 - DNA, 25 bp, Artificial Sequence
  Chemically synthesized oligonucleotide Cpf1 cTAG M
tttgggttaaagatggttaaatgat

SEQ ID NO: 97 - DNA, 25 bp, Artificial Sequence
  Chemically synthesized oligonucleotide Cpf1 cTAG N
tttgggatgttaagagtccctatct

SEQ ID NO: 98 - DNA, 25 bp, Artificial Sequence
  Chemically synthesized oligonucleotide Cpf1 cTAG O
tttgaccgccccccccataccccaa

SEQ ID NO: 99 - DNA, 27 bp, Artificial Sequence
  Chemically synthesized oligonucleotide Cpf1 cTAG P
tttgaggagtgttcagtctccgtgaac

SEQ ID NO: 100 - DNA, 5093 bp, Artificial Sequence
  Synthetically constructed plasmid pZHR039 (Kanamycin resistance, GFP)
actacctagctgcattttcaggaggaagcgatgggcggccgcacaccttctatgcggtgtgaaataccgccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactgataatgggtgagtgagtgtgtgcgtgtggggcgcgccagatgggaacagctagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctagaggatcgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgactccagtctttctagaagatggcaaacagctattatgggtattatgggtccccgaagcagggttatgcagcggaaaagctccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagccggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggactgggtggaatcccttctgcagcacctggattaccctgttatccctagt

SEQ ID NO: 101 - DNA, 13737 bp, Artificial Sequence
  Synthetically constructed plasmid 13000223370 Cat01 (Chloramphenicol source)
gaatcttatcccatggctaagaaagtagacacctcgaacgctacccccgctctagcccttcttacggagaggcaaattccttttgagctggatgttcatgatgtagatccaaaatcatcaaagggcttcgcattggatgcctctgaagtaatgggtgtggagccggaagtggtgtttaaaacgctcatggcagatattgatggtgaacacgtggtcgcgattgttccagccagcagcacgttgaatctcaagcagttggctaaggctggaaaaggtaagcatgcaaacatgatggatcgcagccgtgcacaggtagtcacggggtatgtccctggtggaatctcaccgatagggcagaagaataagcaccgcgtgtttttggatgagtctgcaattctccaggagcgaatctacgtcagcgcaggacgccgaggctggtcactgattatcgccccggatgatgttcttctggctaccgatggggtttacgcggatattgctgatcattcataaaaggtaaaacccacccccgcaggggtgcgtcgtaaagcaagctccttttcttagtacggcgcgatagtggactcgtgcgcgtcgatgttgatgcggccgtgcacggacgggaatgcgcgctgcgcgcagttctcgcgggtgcacactcggcagccggacccgatgggggtggcggtggataggtcctggaggttgaagccgcgggagtacacggtgcggtcggcgtggcgcgcttcgcagccgagcccgatggcgaacattttgtccacttcgccgaaccgggcttcgtggtgtcgcacggtgcgtgagatccacaggtagttgcgtccgtcgggcatttgcgcgaattggcggagcacttggccggggttggtgaaggtttcaaacacgttccacagggggcaggtgccgccgtagtgggtgaagtggaagccggtggcggattggcgtttggacatgttgccggcgcggtcgacgcgcacgaaggtaaacgggatgccgcgcaggttgggacgctgcagggtggacaggcggtgggcggtcgtctcgtagcccacgccgaaaagctgacctaggtattcgatgtcgtagccggatttttcggcctcggagtggaagattttgtagggcagcattacggcggcggcgaagtaggaggcgacgccgcggatggctagggtgcgggcttcgggggtggaccagatgccgtcgtcgacgatgccttcgatgaggtcgttggcttctaggtagccgagttcggtggccatgcggaaggcgcgttgtccggggttgaggcgtgcgtggattgtcagtaggcgcgtctcggggtcaaagtggtgcagcgtgccggattcctctttggaggaggtgatggtgacatcgtgatccatttgcaggcgcctggcgatcgaatcttccatggcgcgggaatcgtacggctgccagcccagttgcgcggcgatggcttcggcgcggcggtcgagcgcatcgaagtagttttggcgggcgtaaatgaaatcgcgcacctcttcgtgcggcatgctcacggcctccgcgatggggcgacgttcctcaggcgtgttggtgcgattgtccactgcgatggagaacttgtcgcgtacgtttcggtagcgctggtgcatttccaccatggcgcgcgccagctgcgggtggttgtacaccatctccgatagctcttggagctccacgttcgcggggttgatctcccggtccaacatgacatcctgaacttcagctaaaaggcgggaatcatcgtcgcgggagaaaaacgttgcgtctacgccgaacgcctcggtgatgcgcaataacaccggtacggtgagcgggcgtacgtcgtgctcaatctgatttacataactggcagataagccaagggttgctgccaacgacgcctggctcaggtctctttcgcggcgcagttggcgcagcctggaccccacatatgtctttcccatggcgcaactatagcgtgatcaccatcaccttaaccactcttggcattgaggtgttgcaaacctcagaggctaaagaacaagggcttactgtgcgcagaggtgccctcaccggggtcaaaaatttgacatccggtgagggtaataccagcacagcctagtctcgccagaatgctggtcagcatacgaaagagcttaaggcaggccaattcgcactgtcagggtcacttgggtgtttagcactaccgacaggtacgctagtatgcgttcttcctaccagaggtctgtggccgcgtggtcaaaagtgcggctttcgtatttgctgctcgtgtttactctcacacttagctttgacctgcacaaatagttgcaaattgtcccacatacacataaagtagcttgcgtatttaaaattatgaacctaaggggtttagcacttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatggagaaaaagatcacgggctacactaccgtggacatctcgcaatggcatcgcaaggaacacttcgaggcatttcaaagcgtggcacaatgtacttacaaccagaccgtccagctggatattaccgcgtttttgaagaccgttaagaaaaacaagcacaagttttatccagcctttatccatattctcgcccgcttgatgaatgcgcaccccgaatttcgtatggccatgaaagatggtgagctcgttatctgggactcagtccatccatgctataccgttttccacgaacaaactgaaactttttcttcgctgtggtccgaatatcacgatgatttccgccaatttttgcatatctacagccaagatgtcgcgtgctatggtgaaaacctggcttactttcccaagggattcatcgagaatatgttctttgtttcagcaaacccctgggtgtccttcacgtcgtttgacttgaacgtggccaatatggataatttcttcgctccagttttcaccatgggtaagtactatacccaaggagacaaggtccttatgccacttgcaatccaagtacaccacgcagtctgcgatggtttccatgtgggacgcatgcttaacgaactccaacagtactgtgatgaatggcaaggcggcgcgtagccccccaaccgaagttgaggggatttttgaatcctcggtcccccttgtccttccagattgatcgacgcgttgttgattttcgcttttcgacgcagcccgccgccatcgggtgcccggcgtggtcaggccacatgcgccccgggaactttttgggcacctacggtgcaacagttgcgaaaattgtgtcacctgcgcaaagccttgcttctattcgggaaattcgggtgtctaaactttttggttgataccaaacggggttagaaactgttcagatcggtatcctgtgaggaagctcaccttggttttagaatgttgaaaaagcctcacgtttccgcaggtagagcacactcaattaaatgagcgtcaaacgacaataaagtaaggctaccctaataactggggttttatgcctctaaacagtcagttgggggcggtaggggagcgtcccatgactggttaatgcctcgatctgggacgtacagtaacagcgacactggaggtgccatgactgttagaaatcccgaccgtgaggcaatccgtcacggaaaaattacgacggaggcgctgcgtgagcgtcccgcatacccgacctgggcaatgaagctgaccatggccatcactggcctaatcttcggtggcttcgttcttgttcacatgatcggaaacctgaaaatcttcatgccggactacgcagccgattctgcgcatccgggtgaagcacaagtagatgtctacggcgagttcctgcgtgagatcggatccccgatcctcccacacggctcagtcctctggatcctacgtattatcctgctggtcgcattggttctgcacatctactgtgcattcgcattgaccggccgttctcaccagtcccgcggaaagttccgccgtaccaacctcgttggcggcttcaactccttcgcgacccgctccatgctggtgaccggaatcgttctccttgcgttcattatcttccacatcctcgacctgaccatgggtgttgctccagcagccccaacttcattcgagcacggcgaagtatacgcaaatatggtggcttcctttagccgctggcctgtagcaatttggtacatcattgccaacctggtcctgttcgtccacctgtctcacggcatctggcttgcagtctctgacctgggaatcaccggacgtcgctggagggcaatcctcctcgcagttgcgtacatcgttcctgcactggtcctgatcggcaacatcaccattccgttcgccatcgctgttggctggattgcgtaaaggttaggaagaatttatgagcactcactctgaaaccacccgcccagagttcatccacccagtctcagtcctcccagaggtctcagctggtacggtccttgacgctgctgagccagcaggcgttcccaccaaagatatgtgggaataccaaaaagaccacatgaacctggtctccccactgaaccgacgcaagttccgcgtcctcgtcgttggcaccggcctgtccggtggcgctgcagcagcagccctcggcgaactcggatacgacgtcaaggcgttcacctaccacgacgcacctcgccgtgcgcactccattgctgcacagggtggcgttaactccgcccgcggcaagaaggtagacaacgacggcgcataccgccacgtcaaggacaccgtcaagggcggcgactaccgtggccgcgagtccgactgctggcgtctcgccgtcgagtccgtccgcgtcatcgaccacatgaacgccatcggtgcaccattcgcccgcgaatacggtggcgccttggcaacccgttccttcggtggtgtgcaggtctcccgtacctactacacccgtggacaaaccggacagcagctgcagctctccaccgcatccgcactacagcgccagatccacctcggctccgtagagatcttcacccataacgaaatggttgacgtaattgtcaccgaacgtaatggtgaaaagcgctgcgaaggcctgatcatgcgcaacctgatcaccggcgagctcaccgcacacaccggccatgccgttatcctggcaaccggtggctacggcaacgtgtaccacatgtccaccctggcgaagaactccaacgcctctagggataacagggtaatacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgataagctagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctagaggatcgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgtgagctgtttacaattaatcatcgtgtggtaccatgtgtggaattggaaaggacatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagtttctgaatttgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccgagcttcctgctgaacatcaaaggcaagaaaacatctgttgtcaaagacagcatccttgaacaaggacaattaacagttaacaaataaaaacgcaaaagaaaatgccgatgggtaccgagcgaaatgaccgaccaagcgacgcccaacctgccatcacgagatttcgattccaccgccgccttctatgaaaggttgggcttcggaatcgttttccgggacgccctcgcggacgtgctcatagtccaataactacattgagcgaaatgccaaccacatgtcccatgcttttactaatgtggggtcttagaagaaagcgaccaatttaaggagagttgaatatgtctgaaatccagctgacggaggcatcattgaacgaagcagccgatgctgcaattaaagcgttcgatggagcacaaaacctcgatgaattggctgctctgcgacgagatcacctgggtgatgcggcaccaatccctcaggcacgccgctcgcttggaaccattccaaaagatcagcgtaaggatgccggacgattcgtaaacatggcgctgggccgcgcggaaaagcacttcgcccaggttaaggtggttcttgaagaaaagcgaaacgcagaagtcctggagctggagcgcgtggatgttaccgtccctaccacacgtgaacaagtcggcgcactgcacccaattacgattctcaacgaacagatcgcggacatctttgttggcatgggctgggagatcgcagagggcccggaagttgaagccgaatacttcaatttcgatgcacttaactttctcccagaccacccagcccgcaccctgcaggataccttccacatcgcacctgaaggatcgcgccaagtgttgcgcacccatacctctcctgtccaggttcgcacgatgctgaatcgagaggtacctatctatatcgcctgtcctggtcgcgtcttccgcactgacgaattggatgctacccacacccctgtctttcaccagatcgagggcctggctgtcgacaaaggcctgacaatggctcaccttcgcggaactctggatcacttggctaaagaactgttcggacctgagactaaaacccgcatgcgttcaaactacttcccattttctgagcccagcgcggaagttgatgtctggttcccaaataagaagggcggtgccggctggatcgaatggggcggctgcggcatggtcaacccaaacgtgctccgcgctgtaggcgtcgacccggaagaatacactggattcggcttcggtatgggtattgaacgcaccttgcaattccgaaatggactctcagatatgcgcgatatggtagaaggcgacattcgctttaccctccctttcggcattcaggcttaggcatttttagtacgtgcaataaccactctggtttttccagggtggttttttgatgccctttttggagtcttcaactgagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagctccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagccggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggtatgcggtgtgaaataccgccatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttaactataacggtcctaaggtagcgaa

SEQ ID NO: 102 - DNA, 6351 bp, Artificial Sequence
  Synthetically constructed plasmid pJDI427
ttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactgataatgggtgagtgagtgtgtgcgtgtggggcgcgccagatgggaacagctagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctagaggatcgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgactccagtctttctagaagatggcaaacagctattatgggtattatgggtccccgaagcagggttatgcagcggaaaagctccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagccggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggactgggtggaatcccttctgcagcacctggattaccctgttatccctagttttgggttaaagatggttaaatgattcgaaaataataaagggaaaatcagtttttgatatcaaaattatacatgtcaacgataatacaaaatataatacaaactataagatgttatcagtatttattatgcatttagaataaattttgtgtcgcccttaattgtgagcggataacaattacgagcttcatgcacagtgaaatcatgaaaaatttatttgctttgtgagcggataacaattataatatgtggaattgtgagcgctcacaattccacaacggtttccctctagaaataattttgtttaacttttcgagaccttaggaggtaaacatatgacggcattgacggaaggtgcaaaactgtttgagaaagagatcccgtatatcaccgaactggaaggcgacgtcgaaggtatgaaatttatcattaaaggcgagggtaccggtgacgcgaccacgggtaccattaaagcgaaatacatctgcactacgggcgacctgccggtcccgtgggcaaccctggtgagcaccctgagctacggtgttcagtgtttcgccaagtacccgagccacatcaaggatttctttaagagcgccatgccggaaggttatacccaagagcgtaccatcagcttcgaaggcgacggcgtgtacaagacgcgtgctatggttacctacgaacgcggttctatctacaatcgtgtcacgctgactggtgagaactttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacattacctaccacaccaaactgagcaaagaccgcgacgagcgccgtgatcacatgtgtctggtagaggtcgtgaaagcggttgatctggacacgtatcagtaatgagaattctgtacactcgagggtctcaccccaagggcgacaccccctaattagcccgggcgaaaggcccagtctttcgactgagcctttcgttttatttgatgcctggcagttccctactctcgcatggggagtccccacactaccatcggcgctacggcgtttcacttctgagttcggcatgtcgaagatagggactcttaacatcccaaaactacctagctgcattttcaggaggaagcgatgggcggccgcacaccttctatgcggtgtgaaataccgccatgaccaaaatcccttaacgtgagttttcgttccactgagcgtcagaccccgtagaaaagatcaaaggatcttc

SEQ ID NO: 103 - DNA, 6351 bp, Artificial Sequence
  Synthetically constructed plasmid pJDI429
ttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactgataatgggtgagtgagtgtgtgcgtgtggggcgcgccagatgggaacagctagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctagaggatcgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgactccagtctttctagaagatggcaaacagctattatgggtattatgggtccccgaagcagggttatgcagcggaaaagctccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagccggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggactgggtggaatcccttctgcagcacctggattaccctgttatccctagttttgggatgttaagagtccctatcttcgaaaataataaagggaaaatcagtttttgatatcaaaattatacatgtcaacgataatacaaaatataatacaaactataagatgttatcagtatttattatgcatttagaataaattttgtgtcgcccttaattgtgagcggataacaattacgagcttcatgcacagtgaaatcatgaaaaatttatttgctttgtgagcggataacaattataatatgtggaattgtgagcgctcacaattccacaacggtttccctctagaaataattttgtttaacttttcgagaccttaggaggtaaacatatgacggcattgacggaaggtgcaaaactgtttgagaaagagatcccgtatatcaccgaactggaaggcgacgtcgaaggtatgaaatttatcattaaaggcgagggtaccggtgacgcgaccacgggtaccattaaagcgaaatacatctgcactacgggcgacctgccggtcccgtgggcaaccctggtgagcaccctgagctacggtgttcagtgtttcgccaagtacccgagccacatcaaggatttctttaagagcgccatgccggaaggttatacccaagagcgtaccatcagcttcgaaggcgacggcgtgtacaagacgcgtgctatggttacctacgaacgcggttctatctacaatcgtgtcacgctgactggtgagaactttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacattacctaccacaccaaactgagcaaagaccgcgacgagcgccgtgatcacatgtgtctggtagaggtcgtgaaagcggttgatctggacacgtatcagtaatgagaattctgtacactcgagggtctcaccccaagggcgacaccccctaattagcccgggcgaaaggcccagtctttcgactgagcctttcgttttatttgatgcctggcagttccctactctcgcatggggagtccccacactaccatcggcgctacggcgtttcacttctgagttcggcatgtcgattggggtatggggggggcggtcaaaactacctagctgcattttcaggaggaagcgatgggcggccgcacaccttctatgcggtgtgaaataccgccatgaccaaaatcccttaacgtgagttttcgttccactgagcgtcagaccccgtagaaaagatcaaaggatcttc

SEQ ID NO: 104 - DNA, 6353 bp, Artificial Sequence
  Synthetically constructed plasmid pJDI430
ttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactgataatgggtgagtgagtgtgtgcgtgtggggcgcgccagatgggaacagctagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctagaggatcgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgactccagtctttctagaagatggcaaacagctattatgggtattatgggtccccgaagcagggttatgcagcggaaaagctccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagccggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggactgggtggaatcccttctgcagcacctggattaccctgttatccctagttttgaggagtgttcagtctccgtgaactcgaaaataataaagggaaaatcagtttttgatatcaaaattatacatgtcaacgataatacaaaatataatacaaactataagatgttatcagtatttattatgcatttagaataaattttgtgtcgcccttaattgtgagcggataacaattacgagcttcatgcacagtgaaatcatgaaaaatttatttgctttgtgagcggataacaattataatatgtggaattgtgagcgctcacaattccacaacggtttccctctagaaataattttgtttaacttttcgagaccttaggaggtaaacatatgacggcattgacggaaggtgcaaaactgtttgagaaagagatcccgtatatcaccgaactggaaggcgacgtcgaaggtatgaaatttatcattaaaggcgagggtaccggtgacgcgaccacgggtaccattaaagcgaaatacatctgcactacgggcgacctgccggtcccgtgggcaaccctggtgagcaccctgagctacggtgttcagtgtttcgccaagtacccgagccacatcaaggatttctttaagagcgccatgccggaaggttatacccaagagcgtaccatcagcttcgaaggcgacggcgtgtacaagacgcgtgctatggttacctacgaacgcggttctatctacaatcgtgtcacgctgactggtgagaactttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacattacctaccacaccaaactgagcaaagaccgcgacgagcgccgtgatcacatgtgtctggtagaggtcgtgaaagcggttgatctggacacgtatcagtaatgagaattctgtacactcgagggtctcaccccaagggcgacaccccctaattagcccgggcgaaaggcccagtctttcgactgagcctttcgttttatttgatgcctggcagttccctactctcgcatggggagtccccacactaccatcggcgctacggcgtttcacttctgagttcggcatgtcgaagatagggactcttaacatcccaaaactacctagctgcattttcaggaggaagcgatgggcggccgcacaccttctatgcggtgtgaaataccgccatgaccaaaatcccttaacgtgagttttcgttccactgagcgtcagaccccgtagaaaagatcaaaggatcttc

SEQ ID NO: 105 - DNA, 6353 bp, Artificial Sequence
  Synthetically constructed plasmid pJDI431
ttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactgataatgggtgagtgagtgtgtgcgtgtggggcgcgccagatgggaacagctagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctagaggatcgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgactccagtctttctagaagatggcaaacagctattatgggtattatgggtccccgaagcagggttatgcagcggaaaagctccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagccggaagaggagtagggaatattactggctgaaaataagtcttgaatgaacgtatacgcgtatatttctaccaatctctcaacactgagtaatggtagttataagaaagagaccgagttagggacagttagaggcggtggagatattccttatggcatgtctggcgatgataaaacttttcaaacggcagccccgatctaaaagagctgacagggaaatggtcagaaaaagaaacgtgcacccgcccgtctggacgcgccgctcacccgcacggcagagaccaatcagtaaaaatcaacggttaacgacattactatatatataatataggaagcatttaatagaacagcatcgtaatatatgtgtactttgcagttatgacgccagatggcagtagtggaagatattctttattgaaaaatagcttgtcaccttacgtacaatcttgatccggagcttttctttttttgccgattaagaattcggtcgaaaaaagaaaaggagagggccaagagggagggcattggtgactattgagcacgtgagtatacgtgattaagcacacaaaggcagcttggagtatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaataggttattactgagtagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggactgggtggaatcccttctgcagcacctggattaccctgttatccctagttttgaggagtgttcagtctccgtgaactcgaaaataataaagggaaaatcagtttttgatatcaaaattatacatgtcaacgataatacaaaatataatacaaactataagatgttatcagtatttattatgcatttagaataaattttgtgtcgcccttaattgtgagcggataacaattacgagcttcatgcacagtgaaatcatgaaaaatttatttgctttgtgagcggataacaattataatatgtggaattgtgagcgctcacaattccacaacggtttccctctagaaataattttgtttaacttttcgagaccttaggaggtaaacatatgacggcattgacggaaggtgcaaaactgtttgagaaagagatcccgtatatcaccgaactggaaggcgacgtcgaaggtatgaaatttatcattaaaggcgagggtaccggtgacgcgaccacgggtaccattaaagcgaaatacatctgcactacgggcgacctgccggtcccgtgggcaaccctggtgagcaccctgagctacggtgttcagtgtttcgccaagtacccgagccacatcaaggatttctttaagagcgccatgccggaaggttatacccaagagcgtaccatcagcttcgaaggcgacggcgtgtacaagacgcgtgctatggttacctacgaacgcggttctatctacaatcgtgtcacgctgactggtgagaactttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacattacctaccacaccaaactgagcaaagaccgcgacgagcgccgtgatcacatgtgtctggtagaggtcgtgaaagcggttgatctggacacgtatcagtaatgagaattctgtacactcgagggtctcaccccaagggcgacaccccctaattagcccgggcgaaaggcccagtctttcgactgagcctttcgttttatttgatgcctggcagttccctactctcgcatggggagtccccacactaccatcggcgctacggcgtttcacttctgagttcggcatgtcgattggggtatggggggggcggtcaaaactacctagctgcattttcaggaggaagcgatgggcggccgcacaccttctatgcggtgtgaaataccgccatgaccaaaatcccttaacgtgagttttcgttccactgagcgtcagaccccgtagaaaagatcaaaggatcttc

SEQ ID NO: 106 - DNA, 4155 bp, Artificial Sequence
  Synthetically constructed plasmid pJDI432
gcccctgcagccgaattatattatttttgccaaataatttttaacaaaagctctgaagtcttcttcatttaaattcttagatgatacttcatctggaaaattgtcccaattagtagcatcacgctgtgagtaagttctaaaccatttttttattgttgtattatctctaatcttactactcgatgagttttcggtattatctctatttttaacttggagcaggttccattcattgtttttttcatcatagtgaataaaatcaactgctttaacacttgtgcctgaacaccatatccatccggcgtaatacgactcactatagggagagcggccgccagatcttccggatggctcgagtttttcagcaagattttgggttaaagatggttaaatgattcgacatacacataaagtagcttgcgtatttaaaattatgaacctaaggggtttagcacttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatggagaaaaagatcacgggctacactaccgtggacatctcgcaatggcatcgcaaggaacacttcgaggcatttcaaagcgtggcacaatgtacttacaaccagaccgtccagctggatattaccgcgtttttgaagaccgttaagaaaaacaagcacaagttttatccagcctttatccatattctcgcccgcttgatgaatgcgcaccccgaatttcgtatggccatgaaagatggtgagctcgttatctgggactcagtccatccatgctataccgttttccacgaacaaactgaaactttttcttcgctgtggtccgaatatcacgatgatttccgccaatttttgcatatctacagccaagatgtcgcgtgctatggtgaaaacctggcttactttcccaagggattcatcgagaatatgttctttgtttcagcaaacccctgggtgtccttcacgtcgtttgacttgaacgtggccaatatggataatttcttcgctccagttttcaccatgggtaagtactatacccaaggagacaaggtccttatgccacttgcaatccaagtacaccacgcagtctgcgatggtttccatgtgggacgcatgcttaacgaactccaacagtactgtgatgaatggcaaggcggcgcgtagccccccaaccgaagttgaggggatttttgaatcctcggtcccccttgtccttccagtcgaagatagggactcttaacatcccaaaatctttctagaagatctcctacaatattctcagctgccatggaaaatcgatgttcttcttttattctctcaagattttcaggctgtatattaaaacttatattaagaactatgctaaccacctcatcaggaaccgttgtaggtggcgtgggttttcttggcaatcgactctcatgaaaactacgagctaaatattcaatatgttcctcttgaccaactttattctgcattttttttgaacgaggtttagagcaagcttcaggaaactgagacaggaattttattaaaaatttaaattttgaagaaagttcagggttaatagcatccattttttgctttgcaagttcctcagcattcttaacaaaagacgtctcttttgacatgtttaaagtttaaacctcctgtgtgaaattattatccgctcataattccacacattatacgagccggaagcataaagtgtaaagcctggggtgcctaatgagtgagctaactcacattaattgcgttgcgctcactgccaattgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcc

SEQ ID NO: 107 - DNA, 4155 bp, Artificial Sequence
  Synthetically constructed plasmid pJDI434
gcccctgcagccgaattatattatttttgccaaataatttttaacaaaagctctgaagtcttcttcatttaaattcttagatgatacttcatctggaaaattgtcccaattagtagcatcacgctgtgagtaagttctaaaccatttttttattgttgtattatctctaatcttactactcgatgagttttcggtattatctctatttttaacttggagcaggttccattcattgtttttttcatcatagtgaataaaatcaactgctttaacacttgtgcctgaacaccatatccatccggcgtaatacgactcactatagggagagcggccgccagatcttccggatggctcgagtttttcagcaagattttgggatgttaagagtccctatcttcgacatacacataaagtagcttgcgtatttaaaattatgaacctaaggggtttagcacttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatggagaaaaagatcacgggctacactaccgtggacatctcgcaatggcatcgcaaggaacacttcgaggcatttcaaagcgtggcacaatgtacttacaaccagaccgtccagctggatattaccgcgtttttgaagaccgttaagaaaaacaagcacaagttttatccagcctttatccatattctcgcccgcttgatgaatgcgcaccccgaatttcgtatggccatgaaagatggtgagctcgttatctgggactcagtccatccatgctataccgttttccacgaacaaactgaaactttttcttcgctgtggtccgaatatcacgatgatttccgccaatttttgcatatctacagccaagatgtcgcgtgctatggtgaaaacctggcttactttcccaagggattcatcgagaatatgttctttgtttcagcaaacccctgggtgtccttcacgtcgtttgacttgaacgtggccaatatggataatttcttcgctccagttttcaccatgggtaagtactatacccaaggagacaaggtccttatgccacttgcaatccaagtacaccacgcagtctgcgatggtttccatgtgggacgcatgcttaacgaactccaacagtactgtgatgaatggcaaggcggcgcgtagccccccaaccgaagttgaggggatttttgaatcctcggtcccccttgtccttccagtcgattggggtatggggggggcggtcaaaatctttctagaagatctcctacaatattctcagctgccatggaaaatcgatgttcttcttttattctctcaagattttcaggctgtatattaaaacttatattaagaactatgctaaccacctcatcaggaaccgttgtaggtggcgtgggttttcttggcaatcgactctcatgaaaactacgagctaaatattcaatatgttcctcttgaccaactttattctgcattttttttgaacgaggtttagagcaagcttcaggaaactgagacaggaattttattaaaaatttaaattttgaagaaagttcagggttaatagcatccattttttgctttgcaagttcctcagcattcttaacaaaagacgtctcttttgacatgtttaaagtttaaacctcctgtgtgaaattattatccgctcataattccacacattatacgagccggaagcataaagtgtaaagcctggggtgcctaatgagtgagctaactcacattaattgcgttgcgctcactgccaattgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcc

SEQ ID NO: 108 - DNA, 4157 bp, Artificial Sequence
  Synthetically constructed plasmid pJDI435
gcccctgcagccgaattatattatttttgccaaataatttttaacaaaagctctgaagtcttcttcatttaaattcttagatgatacttcatctggaaaattgtcccaattagtagcatcacgctgtgagtaagttctaaaccatttttttattgttgtattatctctaatcttactactcgatgagttttcggtattatctctatttttaacttggagcaggttccattcattgtttttttcatcatagtgaataaaatcaactgctttaacacttgtgcctgaacaccatatccatccggcgtaatacgactcactatagggagagcggccgccagatcttccggatggctcgagtttttcagcaagattttgaggagtgttcagtctccgtgaactcgacatacacataaagtagcttgcgtatttaaaattatgaacctaaggggtttagcacttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatggagaaaaagatcacgggctacactaccgtggacatctcgcaatggcatcgcaaggaacacttcgaggcatttcaaagcgtggcacaatgtacttacaaccagaccgtccagctggatattaccgcgtttttgaagaccgttaagaaaaacaagcacaagttttatccagcctttatccatattctcgcccgcttgatgaatgcgcaccccgaatttcgtatggccatgaaagatggtgagctcgttatctgggactcagtccatccatgctataccgttttccacgaacaaactgaaactttttcttcgctgtggtccgaatatcacgatgatttccgccaatttttgcatatctacagccaagatgtcgcgtgctatggtgaaaacctggcttactttcccaagggattcatcgagaatatgttctttgtttcagcaaacccctgggtgtccttcacgtcgtttgacttgaacgtggccaatatggataatttcttcgctccagttttcaccatgggtaagtactatacccaaggagacaaggtccttatgccacttgcaatccaagtacaccacgcagtctgcgatggtttccatgtgggacgcatgcttaacgaactccaacagtactgtgatgaatggcaaggcggcgcgtagccccccaaccgaagttgaggggatttttgaatcctcggtcccccttgtccttccagtcgaagatagggactcttaacatcccaaaatctttctagaagatctcctacaatattctcagctgccatggaaaatcgatgttcttcttttattctctcaagattttcaggctgtatattaaaacttatattaagaactatgctaaccacctcatcaggaaccgttgtaggtggcgtgggttttcttggcaatcgactctcatgaaaactacgagctaaatattcaatatgttcctcttgaccaactttattctgcattttttttgaacgaggtttagagcaagcttcaggaaactgagacaggaattttattaaaaatttaaattttgaagaaagttcagggttaatagcatccattttttgctttgcaagttcctcagcattcttaacaaaagacgtctcttttgacatgtttaaagtttaaacctcctgtgtgaaattattatccgctcataattccacacattatacgagccggaagcataaagtgtaaagcctggggtgcctaatgagtgagctaactcacattaattgcgttgcgctcactgccaattgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcc

SEQ ID NO: 109 - DNA, 4159 bp, Artificial Sequence
  Synthetically constructed plasmid pJDI436
gcccctgcagccgaattatattatttttgccaaataatttttaacaaaagctctgaagtcttcttcatttaaattcttagatgatacttcatctggaaaattgtcccaattagtagcatcacgctgtgagtaagttctaaaccatttttttattgttgtattatctctaatcttactactcgatgagttttcggtattatctctatttttaacttggagcaggttccattcattgtttttttcatcatagtgaataaaatcaactgctttaacacttgtgcctgaacaccatatccatccggcgtaatacgactcactatagggagagcggccgccagatcttccggatggctcgagtttttcagcaagattttgaggagtgttcagtctccgtgaactcgacatacacataaagtagcttgcgtatttaaaattatgaacctaaggggtttagcacttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatggagaaaaagatcacgggctacactaccgtggacatctcgcaatggcatcgcaaggaacacttcgaggcatttcaaagcgtggcacaatgtacttacaaccagaccgtccagctggatattaccgcgtttttgaagaccgttaagaaaaacaagcacaagttttatccagcctttatccatattctcgcccgcttgatgaatgcgcaccccgaatttcgtatggccatgaaagatggtgagctcgttatctgggactcagtccatccatgctataccgttttccacgaacaaactgaaactttttcttcgctgtggtccgaatatcacgatgatttccgccaatttttgcatatctacagccaagatgtcgcgtgctatggtgaaaacctggcttactttcccaagggattcatcgagaatatgttctttgtttcagcaaacccctgggtgtccttcacgtcgtttgacttgaacgtggccaatatggataatttcttcgctccagttttcaccatgggtaagtactatacccaaggagacaaggtccttatgccacttgcaatccaagtacaccacgcagtctgcgatggtttccatgtgggacgcatgcttaacgaactccaacagtactgtgatgaatggcaaggcggcgcgtagccccccaaccgaagttgaggggatttttgaatcctcggtcccccttgtccttccagtcgattggggtatggggggggcggtcaaaaaatctttctagaagatctcctacaatattctcagctgccatggaaaatcgatgttcttcttttattctctcaagattttcaggctgtatattaaaacttatattaagaactatgctaaccacctcatcaggaaccgttgtaggtggcgtgggttttcttggcaatcgactctcatgaaaactacgagctaaatattcaatatgttcctcttgaccaactttattctgcattttttttgaacgaggtttagagcaagcttcaggaaactgagacaggaattttattaaaaatttaaattttgaagaaagttcagggttaatagcatccattttttgctttgcaagttcctcagcattcttaacaaaagacgtctcttttgacatgtttaaagtttaaacctcctgtgtgaaattattatccgctcataattccacacattatacgagccggaagcataaagtgtaaagcctggggtgcctaatgagtgagctaactcacattaattgcgttgcgctcactgccaattgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcc

SEQ ID NO: 110 - RNA, 41 nt, Artificial Sequence
  Synthetically constructed RNA targeting cTAG M
uaauuucuacucuuguagaugguuaaagaugguuaaaugau

SEQ ID NO: 111 - RNA, 41 nt, Artificial Sequence
  Synthetically constructed RNA targeting cTAG N
uaauuucuacucuuguagauggauguuaagagucccuaucu

SEQ ID NO: 112 - RNA, 41 nt, Artificial Sequence
  Synthetically constructed RNA targeting cTAG O
uaauuucuacucuuguagauaccgccccccccauaccccaa

SEQ ID NO: 113 - RNA, 43 nt, Artificial Sequence
  Synthetically constructed RNA targeting cTAG P
uaauuucuacucuuguagauaggaguguucagucuccgugaac

SEQ ID NO: 114 - protein, 9 aa, Unknown
  P53 TAD1 transcription factor domain
ETFSDLWKL

SEQ ID NO: 115 - protein, 9 aa, Unknown
  P53 TAD2 transcription factor domain
DDIEQWFTE

SEQ ID NO: 116 - protein, 8 aa, Unknown
  MLL transcription factor domain
DIMDFVLK

SEQ ID NO: 117 - protein, 9 aa, Unknown
  EA2 transcription factor domain
DLLDFSMMF

SEQ ID NO: 118 - protein, 9 aa, Unknown
  Rtg3 transcription factor domain
ETLDFSLVT

SEQ ID NO: 119 - protein, 9 aa, Unknown
  CREB transcription factor domain
RKILNDLSS

SEQ ID NO: 120 - protein, 9 aa, Unknown
  CREBaB6 transcription factor domain
EAILAELKK

SEQ ID NO: 121 - protein, 9 aa, Unknown
  Gli3 transcription factor domain
DDVVQYLNS

SEQ ID NO: 122 - protein, 9 aa, Unknown
  Gal4 transcription factor domain
DDVYNYLFD

SEQ ID NO: 123 - protein, 9 aa, Unknown
  Oaf1 transcription factor domain
DLFDYDFLV

SEQ ID NO: 124 - protein, 9 aa, Unknown
  Pip2 transcription factor domain
DFFDYDLLF

SEQ ID NO: 125 - protein, 9 aa, Unknown
  Pdr1 transcription factor domain
EDLYSILWS

SEQ ID NO: 126 - protein, 9 aa, Unknown
  Pdr3 transcription factor domain
TDLYHTLWN

SEQ ID NO: 127 - protein, 1228 aa, Lachnospiraceae bacterium ND2006
AASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGAAGYKSLFKKDIIETILPEAADDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNAKTKQALPKFKPLYKQVLSDRESLSFYGEGYTSDEEVLEVFRNTLNKNSEIFSSIKKLEKLFKNFDEYSSAGIFVKNGPAISTISKDIFGEWNLIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFAAAKKNNVFAWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVK

SEQ ID NO: 128 - protein, 1307 aa, Unknown
  Acidaminococcus sp. (strain BV3L6)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

The invention claimed is:

1. A recombinant modular CRISPR DNA construct for modulating the expression of a host cell gene, said construct comprising a CRISPR multi-clonal site, said multi-clonal site comprising:
   a) a plurality of distinct cloning tags (cTAGs), wherein each cTAG comprises:
      i) a validated CRISPR landing site comprising a protospacer sequence operably linked to a protospacer adjacent motif (PAM); wherein the validated CRISPR landing site in at least three of the plurality of distinct cTAGs is different from all other CRISPR landing sites within the modular CRISPR DNA construct; and
   b) a plurality of distinct DNA inserts;
      i) wherein each DNA insert is flanked by a pair of cTAGs; and
   wherein the construct further comprises:
   c) a first nucleic acid encoding a catalytically inactivated CRISPR enzyme; and
   d) a second nucleic acid encoding a guide RNA capable of recruiting the catalytically inactivated CRISPR enzyme of (c) to a DNA target site.

2. The recombinant modular CRISPR DNA construct of claim 1, wherein the first nucleic acid is comprised within a DNA insert within the CRISPR multi-clonal site.

3. The recombinant modular CRISPR DNA construct of claim 2, wherein the DNA insert comprising the first nucleic acid further comprises a selectable marker.

4. The recombinant modular CRISPR DNA construct of claim 1, wherein the second nucleic acid is comprised within an DNA insert within the CRISPR multi-clonal site.

5. The recombinant modular CRISPR DNA construct of claim 4, wherein the DNA insert comprising the second nucleic acid further comprises a selectable marker.

6. The recombinant modular CRISPR DNA construct of claim 1, wherein the first nucleic acid and the second nucleic acid are each comprised within their own DNA inserts within the CRISPR multi-clonal site.

7. The recombinant modular CRISPR DNA construct of claim 6, wherein the DNA insert comprising the first nucleic acid and the second nucleic acid each comprise a selectable marker.

8. The recombinant modular CRISPR DNA construct of claim 7, wherein the selectable marker comprised in the DNA insert comprising the first nucleic acid and the selectable marker comprised in the DNA insert comprising the second nucleic acid are different.

9. The recombinant modular CRISPR DNA construct of claim 1, wherein the construct further comprises (e) a third nucleic acid encoding a transcriptional activation protein that, when expressed, is capable of attaching itself to the catalytically inactivated CRISPR enzyme.

10. The recombinant modular CRISPR DNA construct of claim 1, wherein the construct further comprises (e) a third nucleic acid encoding a transcriptional repressor protein that, when expressed, is capable of attaching itself to the catalytically inactivated CRISPR enzyme.

11. The recombinant modular CRISPR DNA construct of claim 1, wherein the first nucleic acid encodes a catalytically inactivated CRISPR enzyme that is translationally fused to a transcriptional activation protein.

12. The recombinant modular CRISPR DNA construct of claim 11, wherein the transcriptional activation protein is selected from the group consisting of: VP16, VP64, VP160, and VPR.

13. The recombinant modular CRISPR DNA construct of claim 1, wherein the first nucleic acid encodes a catalytically inactivated CRISPR enzyme that is translationally fused to a transcriptional repressor.

14. The recombinant modular CRISPR DNA construct of claim 13, wherein the transcriptional repressor is selected from the group consisting of: Mxi1, Tbx3, KRAB, EnR, and SID.

15. The recombinant modular CRISPR DNA construct of claim 1, wherein at least one of said distinct cTAGs comprises a restriction endonuclease site that is at least 8 bases long.

16. The modular CRISPR DNA construct of claim 1, wherein the catalytically inactivated CRISPR enzyme comprises an amino acid sequence selected from the group consisting of SEQ ID NOs: 38, 127 and 128.

17. A high throughput method of modulating the expression of one or more host cell genes, said method comprising the step of introducing the recombinant modular CRISPR DNA construct of claim 1 into the host cell; wherein the DNA target site of the guide RNA is located within the host cell genome.

18. The high throughput method of claim 17, wherein at least one DNA insert of the recombinant modular CRISPR DNA construct is integrated into the genome of the host cell.

19. The high throughput method of claim 17, wherein the recombinant modular CRISPR DNA construct remains in the host cell as extra chromosomal DNA.

20. A recombinant modular CRISPR DNA construct for screening CRISPR enzyme variants, said construct comprising a CRISPR multi-clonal site, said multi-clonal site comprising:
   a) a plurality of distinct cloning tags (cTAGs), wherein each cTAG comprises:
      i) a validated CRISPR landing site comprising a protospacer sequence operably linked to a protospacer adjacent motif (PAM); wherein the validated CRISPR landing site in at least three of the plurality of distinct cTAGs is different from all other CRISPR landing sites within the modular CRISPR DNA construct; and b) a plurality of distinct DNA inserts;
   i) wherein each DNA insert is flanked by a pair of cTAGs; and
wherein the construct further comprises:
   c) a first nucleic acid encoding a CRISPR enzyme, or a putative CRISPR enzyme; and
   d) a second nucleic acid encoding a guide RNA capable of binding to a DNA target site.

21. The recombinant modular CRISPR DNA construct of claim 20, wherein the first nucleic acid is comprised within a DNA insert within the CRISPR multi-clonal site.

22. The recombinant modular CRISPR DNA construct of claim 21, wherein the DNA insert comprising the first nucleic acid further comprises a selectable marker.

23. The recombinant modular CRISPR DNA construct of claim 20, wherein the second nucleic acid is comprised within an DNA insert within the CRISPR multi-clonal site.

24. The recombinant modular CRISPR DNA construct of claim 23, wherein the DNA insert comprising the second nucleic acid further comprises a selectable marker.

25. The recombinant modular CRISPR DNA construct of claim 20, wherein the first nucleic acid and the second nucleic acid are each comprised within their own DNA inserts within the CRISPR multi-clonal site.

26. The recombinant modular CRISPR DNA construct of claim 25, wherein the DNA inserts comprising the first nucleic acid and the second nucleic acid each comprise a selectable marker.

27. The recombinant modular CRISPR DNA construct of claim 26, wherein the selectable marker comprised in the DNA insert comprising the first nucleic acid and the selectable marker comprised in the DNA insert comprising the second nucleic acid are different.

28. A high throughput method of screening CRISPR enzyme variants, said method comprising the step of introducing the recombinant modular CRISPR DNA construct of claim 20 into the host cell; wherein the DNA target site of the guide RNA is located within the host cell genome.

29. The high throughput method of claim 28, wherein at least one DNA insert of the recombinant modular CRISPR DNA construct is integrated into the genome of the host cell.

30. The high throughput method of claim 28, wherein the recombinant modular CRISPR DNA construct remains in the host cell as extra chromosomal DNA.

\* \* \* \* \*